(12) United States Patent
Olsson et al.

(10) Patent No.: US 10,815,514 B2
(45) Date of Patent: Oct. 27, 2020

(54) PRODUCTION OF STEVIOL GLYCOSIDES IN RECOMBINANT HOSTS

(71) Applicant: EVOLVA SA, Reinach (CH)

(72) Inventors: Kim Olsson, Copenhagen (DK); Joseph Michael Sheridan, Royston (GB); Laura Tatjer Recorda, Copenhagen (DK); Christian Nyffengger, Hvidovre (DK); Veronique Douchin, Frederiksberg (DK)

(73) Assignee: Evolva SA, Reinach (CH)

( * ) Notice: Subject to any disclaimer, the term of this patent is extended or adjusted under 35 U.S.C. 154(b) by 0 days.

(21) Appl. No.: 16/098,347

(22) PCT Filed: May 16, 2017

(86) PCT No.: PCT/EP2017/061775
§ 371 (c)(1),
(2) Date: Nov. 1, 2018

(87) PCT Pub. No.: WO2017/198682
PCT Pub. Date: Nov. 23, 2017

(65) Prior Publication Data
US 2019/0153495 A1   May 23, 2019

Related U.S. Application Data

(60) Provisional application No. 62/337,190, filed on May 16, 2016.

(51) Int. Cl.
*C12P 19/56* (2006.01)
*C12N 9/10* (2006.01)

(52) U.S. Cl.
CPC ............ *C12P 19/56* (2013.01); *C12N 9/1048* (2013.01); *C12N 9/1051* (2013.01)

(58) Field of Classification Search
None
See application file for complete search history.

(56) References Cited

U.S. PATENT DOCUMENTS

| | | | |
|---|---|---|---|
| 4,590,160 A | 5/1986 | Nishihashi et al. | |
| 5,204,253 A | 4/1993 | Sanford et al. | |
| 5,306,862 A | 4/1994 | Chappell et al. | |
| 5,460,949 A | 10/1995 | Saunders et al. | |
| 5,538,880 A | 7/1996 | Lundquist et al. | |
| 6,013,863 A | 1/2000 | Lundquist et al. | |
| 6,215,051 B1 | 4/2001 | Yu et al. | |
| 6,255,557 B1 | 7/2001 | Brandle | |
| 6,284,493 B1 | 9/2001 | Roth | |
| 6,284,506 B1 | 9/2001 | Hoshino et al. | |
| 6,329,571 B1 | 12/2001 | Hiei | |
| 6,586,202 B2 | 7/2003 | Hoshino et al. | |
| 6,660,507 B2 | 12/2003 | Cheng et al. | |
| 6,806,076 B1 | 10/2004 | Miyake et al. | |
| 6,969,595 B2 | 11/2005 | Brzostowicz et al. | |
| 7,034,140 B2 | 4/2006 | Bramucci et al. | |
| 7,056,717 B2 | 6/2006 | Cheng et al. | |
| 7,098,000 B2 | 8/2006 | Cheng et al. | |
| 7,129,392 B2 | 10/2006 | Hahn et al. | |
| 7,132,268 B2 | 11/2006 | Miyake et al. | |
| 7,172,886 B2 | 2/2007 | Keasling et al. | |
| 7,183,089 B2 | 2/2007 | Keasling et al. | |
| 7,186,891 B1 | 3/2007 | Chappell et al. | |
| 7,208,298 B2 | 4/2007 | Miyake et al. | |
| 7,335,815 B2 | 2/2008 | Boronat et al. | |
| 7,364,885 B2 | 4/2008 | Miyake et al. | |
| 7,422,884 B2 | 9/2008 | Bai et al. | |
| 7,514,597 B2 | 4/2009 | Nakamura et al. | |
| 7,569,389 B2 | 9/2009 | Feldmann et al. | |
| 7,692,065 B2 | 4/2010 | Harper et al. | |
| 7,838,287 B2 | 11/2010 | Goldsmith et al. | |
| 7,923,541 B2 | 4/2011 | Yang et al. | |
| 7,927,851 B2 | 4/2011 | Brandle et al. | |
| 7,981,647 B2 | 7/2011 | Berry et al. | |
| 2002/0142408 A1 | 10/2002 | DiCosimo et al. | |
| 2003/0033626 A1 | 2/2003 | Hahn et al. | |
| 2003/0148416 A1 | 8/2003 | Berry et al. | |
| 2003/0148479 A1 | 8/2003 | Keasling et al. | |
| 2003/0190734 A1 | 10/2003 | Hoshino et al. | |
| 2003/0219798 A1 | 11/2003 | Gokarn et al. | |
| 2004/0010815 A1 | 1/2004 | Lange et al. | |
| 2004/0072311 A1 | 4/2004 | DiCosimo et al. | |
| 2004/0078846 A1 | 4/2004 | Desouza et al. | |
| 2004/0176570 A1 | 9/2004 | Bacher et al. | |
| 2004/0194162 A1 | 9/2004 | Hahn et al. | |
| 2005/0003474 A1 | 1/2005 | Desouza | |
| 2005/0032169 A1 | 2/2005 | Miyake et al. | |
| 2006/0014264 A1 | 1/2006 | Sauer | |
| 2006/0079476 A1 | 4/2006 | Keasling et al. | |
| 2006/0083838 A1 | 4/2006 | Jackson et al. | |
| 2007/0004000 A1 | 1/2007 | Miyake et al. | |
| 2007/0077616 A1 | 4/2007 | Keasling et al. | |
| 2007/0099261 A1 | 5/2007 | Keasling et al. | |
| 2007/0118916 A1 | 5/2007 | Puzio et al. | |
| 2007/0128311 A1 | 6/2007 | Prakash et al. | |
| 2007/0166782 A1 | 7/2007 | Keasling et al. | |
| 2007/0202579 A1 | 8/2007 | Berry et al. | |

(Continued)

FOREIGN PATENT DOCUMENTS

| | | |
|---|---|---|
| CN | 101720910 | 6/2010 |
| CN | 102216313 | 10/2011 |

(Continued)

OTHER PUBLICATIONS

Arnold, F.H. 2001 Nature 409: 253-257. (Year: 2001).*

(Continued)

*Primary Examiner* — Marsha Tsay
(74) *Attorney, Agent, or Firm* — McDonnell Boehnen Hulbert & Berghoff LLP

(57) ABSTRACT

The invention relates to recombinant microorganisms and methods for producing steviol glycosides, glycosides of steviol precursors, and steviol glycoside precursors.

6 Claims, 41 Drawing Sheets
Specification includes a Sequence Listing.

(56) References Cited

U.S. PATENT DOCUMENTS

| | | |
|---|---|---|
| 2007/0238157 A1 | 10/2007 | Millis et al. |
| 2007/0238159 A1 | 10/2007 | Millis et al. |
| 2007/0238160 A1 | 10/2007 | Millis et al. |
| 2007/0254354 A1 | 11/2007 | Millis et al. |
| 2007/0269857 A1 | 11/2007 | Miyake et al. |
| 2007/0286850 A1 | 12/2007 | Bai et al. |
| 2008/0064063 A1 | 3/2008 | Brandle |
| 2008/0081358 A1 | 4/2008 | Vittanen et al. |
| 2008/0131926 A1 | 6/2008 | Miyake et al. |
| 2008/0261280 A1 | 10/2008 | Hahn et al. |
| 2008/0271205 A1 | 10/2008 | Yamaguchi et al. |
| 2008/0286870 A1 | 11/2008 | Vittanen et al. |
| 2008/0292775 A1 | 11/2008 | Prakash et al. |
| 2008/0318227 A1 | 12/2008 | Bacher et al. |
| 2009/0004724 A1 | 1/2009 | Keasling et al. |
| 2009/0047718 A1 | 2/2009 | Blaschek et al. |
| 2009/0055974 A1 | 2/2009 | Tanksley et al. |
| 2009/0074935 A1 | 3/2009 | Lee |
| 2009/0143308 A1 | 6/2009 | Monk et al. |
| 2009/0286262 A1 | 11/2009 | Slack |
| 2010/0112156 A1 | 5/2010 | Abelyan et al. |
| 2010/0120096 A1 | 5/2010 | Kitaoka et al. |
| 2010/0221801 A1 | 9/2010 | Van Dyk |
| 2010/0297722 A1 | 11/2010 | Anterola et al. |
| 2010/0316782 A1 | 12/2010 | Shi et al. |
| 2011/0087011 A1 | 4/2011 | Chiang et al. |
| 2011/0092684 A1 | 4/2011 | Abelyan et al. |
| 2011/0126318 A1 | 5/2011 | Allen et al. |
| 2011/0160311 A1 | 6/2011 | Prakash et al. |
| 2012/0021111 A1 | 1/2012 | Pfister et al. |
| 2012/0083593 A1 | 4/2012 | Liu et al. |
| 2012/0164678 A1 | 6/2012 | Stephanopoulos et al. |
| 2012/0178169 A1 | 7/2012 | Voytas et al. |
| 2013/0137138 A1 | 5/2013 | Hansen |
| 2014/0329281 A1 | 11/2014 | Houghton-Larsen et al. |
| 2015/0159188 A1 | 6/2015 | Ono et al. |
| 2015/0342234 A1 | 12/2015 | Hicks et al. |
| 2016/0186225 A1* | 6/2016 | Mikkelsen ................ A23L 2/60 426/590 |

FOREIGN PATENT DOCUMENTS

| | | |
|---|---|---|
| CN | 103397064 | 11/2013 |
| CN | 104845990 | 8/2015 |
| EP | 0955363 | 11/1999 |
| EP | 1072683 | 1/2001 |
| EP | 1171610 | 4/2007 |
| EP | 1198575 | 9/2007 |
| EP | 1383864 | 1/2008 |
| EP | 1897951 | 3/2008 |
| EP | 1947189 | 7/2008 |
| EP | 1392824 | 8/2008 |
| EP | 2575432 | 4/2013 |
| EP | 2902410 | 8/2015 |
| JP | 59101408 | 6/1984 |
| JP | 3-277275 | 12/1991 |
| JP | 05-115298 | 5/1993 |
| JP | 2001048727 | 2/2001 |
| JP | 2009034080 | 2/2009 |
| KR | 1020120088035 | 8/2012 |
| KR | 2015 0000258 | 1/2015 |
| WO | WO 1999/018224 | 4/1999 |
| WO | WO 2000/036081 | 6/2000 |
| WO | WO 2000/037663 | 6/2000 |
| WO | WO 2000/063400 | 10/2000 |
| WO | WO 2001/012828 | 2/2001 |
| WO | WO 2001/083769 | 11/2001 |
| WO | WO 2001/094561 | 12/2001 |
| WO | 2002/024865 | 3/2002 |
| WO | WO 2002/020728 | 3/2002 |
| WO | WO 2002/020815 | 3/2002 |
| WO | WO 2002/055709 | 7/2002 |
| WO | WO 2003/008540 | 1/2003 |
| WO | WO 2004/029255 | 4/2004 |
| WO | WO 2005/079183 | 9/2005 |
| WO | WO 2006/016395 | 2/2006 |
| WO | WO 2006/069610 | 7/2006 |
| WO | WO 2006/093289 | 9/2006 |
| WO | WO 2006/096392 | 9/2006 |
| WO | WO 2007/136847 | 11/2007 |
| WO | WO 2008/008256 | 1/2008 |
| WO | WO 2008/034648 | 3/2008 |
| WO | WO 2008/039499 | 4/2008 |
| WO | WO 2008/051349 | 5/2008 |
| WO | WO 2008/091547 | 7/2008 |
| WO | WO 2009/005704 | 1/2009 |
| WO | WO 2009/037329 | 3/2009 |
| WO | WO 2009/071277 | 6/2009 |
| WO | WO 2009/086049 | 7/2009 |
| WO | WO 2009/105612 | 8/2009 |
| WO | WO 2009/108680 | 9/2009 |
| WO | WO 2009/111513 | 9/2009 |
| WO | 2009/140394 | 11/2009 |
| WO | WO 2009/140394 | 11/2009 |
| WO | WO 2010/021001 | 2/2010 |
| WO | WO 2010/038911 | 4/2010 |
| WO | WO 2010/044960 | 4/2010 |
| WO | 2010/142305 | 12/2010 |
| WO | WO 2010/146463 | 12/2010 |
| WO | WO 2011/028671 | 3/2011 |
| WO | WO 2011/037959 | 3/2011 |
| WO | WO 2011/046423 | 4/2011 |
| WO | WO 2011/056834 | 5/2011 |
| WO | WO 2011/060057 | 5/2011 |
| WO | WO 2011/153378 | 8/2011 |
| WO | 2011/140329 | 11/2011 |
| WO | 2011/151326 | 12/2011 |
| WO | 2011/153378 | 12/2011 |
| WO | WO 2011/151326 | 12/2011 |
| WO | WO 2011/153144 | 12/2011 |
| WO | WO 2012/075030 | 6/2012 |
| WO | 2013/022989 | 2/2013 |
| WO | WO 2013/019050 | 2/2013 |
| WO | WO 2013/022989 | 2/2013 |
| WO | WO 2013/021261 | 5/2013 |
| WO | WO 2013/076577 | 5/2013 |
| WO | WO 2013/096420 | 6/2013 |
| WO | WO 2013/102793 | 7/2013 |
| WO | WO 2013/110673 | 8/2013 |
| WO | WO 2013/176738 | 11/2013 |
| WO | WO 2014/086890 | 6/2014 |
| WO | WO 2014/122227 | 8/2014 |
| WO | WO 2014/122328 | 8/2014 |
| WO | WO 2014172055 | 10/2014 |
| WO | 2014/191580 | 12/2014 |
| WO | 2014/191581 | 12/2014 |
| WO | WO2014/191580 | 12/2014 |
| WO | WO 2014193888 | 12/2014 |
| WO | WO 2014193934 | 12/2014 |
| WO | 2015/011209 | 1/2015 |
| WO | WO 2015/007748 | 1/2015 |
| WO | 2015/014959 | 2/2015 |
| WO | 2015/016393 | 2/2015 |
| WO | WO 2015/014969 | 2/2015 |
| WO | WO 2015/028324 | 3/2015 |
| WO | WO 2015051454 | 4/2015 |
| WO | WO 2015065650 | 5/2015 |
| WO | WO 2015/132411 | 9/2015 |
| WO | 2016/023844 | 2/2016 |
| WO | WO 2016028899 | 2/2016 |
| WO | WO 2016/038095 | 3/2016 |
| WO | WO2016043926 | 3/2016 |
| WO | WO 2016/120486 | 8/2016 |
| WO | WO2016120486 A1 | 8/2016 |
| WO | WO 2017/025362 | 2/2017 |
| WO | WO 2017/098017 | 6/2017 |
| WO | WO 2017/178632 | 10/2017 |

OTHER PUBLICATIONS

Chen et al., "Sugar transporters for intercellular exchange and nutrition of pathogens," Nature 468(7323):527-32 (2010).

(56) References Cited

OTHER PUBLICATIONS

Chen et al., "Fusion protein linkers: Property, design, and functionality", Advanced Drug Delivery reviews, 65 (0):1257-69 (2013).
Daran et al., "Genetic and biochemical characterization of the UGP1 gene encoding the UDP-glucose pyrophosphorylase from *Saccharomyces cerevisiae*," Eur J Biochem. 233(2):520-30 (Jul. 1995).
Husar et al., "Overexpression of the UGT73C6 alters brassinosteriod glucoside formation in *Arabidopsis thaliana*", BMC Plant Biology, 11:1-14 (2011).
Khan et al., "Physical and chemical mutagenesis in Stevia rebaudiana: variant generation with higher UGT expression and glycosidic profile but with low photosynthetic capabilities," Acta Physiologiae Plantarum 38(1) (2016).
Malonek et al., "The NADPH-cytochrome P450 Reductase Gene from Gibberalla fujikuroi is Essential for Gibberellin Biosynthesis", J Bio Chem. 279(24):25075-84 (Jun. 2004).
Mao et al., "Produce steviol glycosides in engineered yeast", 2015 Synthetic Biology: Engineering, Evolution & Design (SEED), Poster Abstract (Jun. 2015).
Nagatoshi et al., "UGT75L6 and UGT94E5 mediate sequential glucosylation of crocetin to crocin in Gardenia asminoides", FEBS Letters, 586:1055-1061 (2012).
Wang et al., "Pathway mining-based integration of critical enzyme parts for de novo biosynthesis of steviol glycoside sweetener in *Escherichia coli*", Cell Research, 26:258-261 (Sep. 2015).
Wang et al., "Efficient enzymatic production of rebaudioside A from stevioside", Bioscience, Biotechnology, and Biochemistry, 80:67-73 (Aug. 2015).
Wang et al., "Design and construction of artificial biological systems for complex natural products biosynthesis", Chinese Journal of Biotechnology, 29:1146-1160 (2013).
Warth et al., "Hydrophilic interaction liquid chromatography coupled with tandem mass spectrometry for the quantification of uridine diphosphate-glucose, uridine diphosphate-glucuronic acid, deoxynivalenol and its glucoside: In-house validation and application to wheat," Journal of Chromatography A, 1423, pp. 183-189 (2015).
Yang et al., "Base substitution mutations in uridinediphosphate-dependent glycosyltransferase 76G1 gene of Stevia rebaudioside A; Mustation in UGT76G1, a key gene of steviol glycoside synthesis", Plant Physiology and Biochemistry, 80:220-225 (2014).
Examination Report issued by the European Patent Office for European Application No. 12750513.9, dated Nov. 26, 2014.
International Search Report issued by the International Searching Authority for International Application No. PCT/US2011/038967, dated Sep. 1, 2011 (10 pages).
Written Opinion of the International Searching Authority for International Application No. PCT/US2011/038967, dated Sep. 1, 2011 (12 pages).
International Preliminary Report on Patentability issued by the International Bureau for International Application No. PCT/US2011/038967, dated Dec. 4, 2012 (13 pages).
Third-Party Submission under 37 CFR 1.290 for U.S. Appl. No. 13/701,406, dated Mar. 7, 2014 (238 pages).
Extended European Search Report and Opinion issued by the European Patent Office for European Application No. 11790428.4, dated Dec. 20, 2013.
Non-Final Office Action for U.S. Appl. No. 14/237,540, dated Dec. 30, 2015 (pp. 1-19).
International Search Report issued by the International Searching Authority for International Application No. PCT/US2012/050021, dated Apr. 12, 2013.
Nritten Opinion of the International Searching Authority for International Application No. PCT/US2012/050021, dated Apr. 12, 2013.
International Preliminary Report on Patentability issued by the International Bureau for International Application No. PCT/US2012/050021, dated Feb. 11, 2014.
Extended European Search Report issued in EP 15193074.0; dated Feb. 12, 2016, pp. 1-9.

International Search Report from the International Searching Authority for International Application No. PCT/EP2014/052363, dated Sep. 22, 2014 (12 pages).
Written Opinion of the International Searching Authority for International Application No. PCT/EP2014/052363, dated Sep. 22, 2014 (10 pages).
International Preliminary Report on Patentability issued by the International Bureau for International Application No. PCT/EP2014/052363, dated Aug. 11, 2015 (11 pages).
International Preliminary Report on Patentability issued by the International Bureau for International Application No. PCT/EP2014/052675, dated Aug. 11, 2015 (8 pages).
International Search Report of the International Searching Authority for International Application No. PCT/EP2013/075587, dated Feb. 20, 2014 (pp. 1-5).
Written Opinion of the International Searching Authority for International Application No. PCT/EP2013/075587, dated Feb. 20, 2014 (pp. 1-9).
International Preliminary Report on Patentability from the International Bureau for International Application No. PCT/EP2013/075587, dated Jun. 9, 2015 (pp. 1-10).
Invitation to Pay Additional Fees and, Where Applicable, Protest Fee by the International Searching Authority for International Application No. PCT/EP2015/070620, dated Nov. 27, 2015 (pp. 1-14).
International Search Report and Written Opinion of the International Searching Authority for International Application No. PCT/EP2015/068314, dated Jan. 20, 2016 (pp. 1-7).
Written Opinion of the International Searching Authority for International Application No. PCT/EP2015/068314, dated Jan. 20, 2016 (pp. 1-9).
Mahe et al., "The ATP Binding Cassette Transporters Pdr5 and Snq2 of *Saccharomyces cerevisiae* Can Mediate Transport of Steroids via in Vivo", JBC, 271(41)25167-25172. (Oct. 1996).
Starratt et al., "Rebaudioside F, a diterpene glycoside from Stevia redaudiana", Phytochemistry, 59(4):367-370. (Feb. 2002). Abstract.
Uniprot Accession No. Q75183, dated Jul. 5, 2004 (pp. 1-2).
Uniprot Accession No. Q75183, dated Jul. 22, 2008 (pp. 1-4).
Saier, "Families of transmembrane sugar transport proteins," Mol Microbiol., 35(4):699-710 (2000).
GenBank Accession No. AZF53544, dated Apr. 14, 2011 (2 pages).
UniProt Accession No. B5MEX6, Nov. 4, 2008 (1 page).
UniProt Accession No. E4MVV7, Feb. 8, 2011 (1 page).
UniProt Accession No. F6KWJ2, Jul. 27, 2011 (1 page).
UniProt Accession No. H9BYK3, May 16, 2012 (1 page).
Mikayama et al., "Molecular cloning and functional expression of a cDNA encoding glycosylation-inhibiting factor," Proc Natl Acad Sci U S A. 90(21):10056-60 (1993).
Rudinger et al., "Characteristics of the amino acids as components of a peptide hormone sequence," Peptide Hormones. Bioi. Council. pp. 5-7 (1976).
GenBank Accession No. AAS07253.1, dated Jan. 31, 2004 (3 pages).
Gloster, "Advances in understanding glycosyltransferases from a structural perspective," Curr Opin Struct Biol. 28:131-41 (2014).
Guo et al., "Protein tolerance to random amino acid change", Proceedings of the National Academy of Sciences USA, vol. 101, No. 25, pp. 9205-9210 (2004).
Liu et al., "Biosynthesis of Rebaudioside A by Whole Cell of Recombinant *Saccharomyces cerevisiae*," Food and Fermentation Industries, 38(7) : 6-10 (2012) (Abstract translation).
Ni et al., "Outer membrane mutation effects on UDP-glucose permeability and whole-cell catalysis rate," Appl Microbiol Biotechnol. 73(2):384-93 (2006).
Prisic et al, "Synergistic substrate inhibition of ent-copalyl diphosphate synthase: a potential feed-forward inhibition mechanism limiting gibberellin metabolism," Plant Physiol. 144(1):445-54 (2007).
Unligil et al., "Glycosyltransferase structure and mechanism," Curr Opin Struct Biol. 10(5):510-7 (2000).
Wanchao et al., "Advances on the Stevoil Glycoside Biosynthesis and Its Key Enzymes," Biotechnology Bulletin, Feb. 2008 (English Abstract translation).

(56) References Cited

OTHER PUBLICATIONS

International Search Report by the International Searching Authority for International Application No. PCT/EP2015/070620; dated Mar. 29, 2016, pp. 1-10.
Written Opinion of the International Searching Authority for International Application No. PCT/EP2015/070620; dated Mar. 29, 2016, pp. 1-24.
Shao et al., "Crystal structures of a multifunctional triterpene/flavonoid glycosyltransferase from Medicago truncatula," Plant Cell 17(11):3141-54 (2005).
Shibata et al., "Glucosylation of Steviol and Steviol-Glucosides in Extracts from Stevia rebaudiana Bertoni" Plant Physiol. 95(1):152-56 (1991).
Singh et al., "Compendium of Transgenic Crop Plants: Transgenic Sugar, Tuber and Fiber," Ed. Kole & Hall, Blackwell Publishing Ltd. pp. 97-115 (2008).
U.S. Food and Drug Administration GRAS Notice 323, "GRAS Assessment of High Purity Steviol Glycosides; Food Usage Conditions for General Recognition of Safety for PureCircle USA, Inc.," pp. 1-262 (Feb. 2010).
U.S Food and Drug Administration GRAS Notice Notice 329, "Notice to the U.S. Food and Drug Administration that the use of RebpureTM (Rebaudioside A) derived from Stevia rebaudiana, as a Food Ingredient is Generally Recognized as Safe (GRAS)," pp. 1-275 (Mar. 2010).
Van Doyen et al., "Heterologous protein production in the yeast Kluyveromyces lactis," FEMS Yeast Res. 6 (3):381-92 (May 2006).
Vazquez De Aldana et al., "Nucleotide sequence of the exo-1,3-beta-glucanase-encoding gene, EXG1, of the yeast Saccharomyces cerevisiae," Gene 97(2):173-82 (1991).
Verwaal et al., "High-Level Production of Beta-Carotene in Saccharomyces cerevisiae by Successive Transformation with Carotenogenic Genes from Xanthophyllomyces dendrorhous," Appl Environ Microbiol. 73 (13):4342-50 (2007).
Wallin, "Steviol Glycosides," Chem. Tech Assessment—63rd JECFA, pp. 1-5 (2004).
Wallin, "Steviol Glycosides," Chem. Tech Assessment—69th JECFA, pp. 1-7 (2007).
Wallner & Elofsson, "Can correct protein models be identified?," Protein Sci. 12(5):1073-86 (May 2003).
Wang, "Structure, mechanism and engineering of plant natural product glycosyltransferases," FEBS Letters 583 (20):3303-9 (2009).
Xu et al., "Generation of hepatitis B virus PreS2-S antigen in Hansenula polymorpha," Virol Sin. 29(6):403-9 (Dec. 2014).
Yadav et al., "A review on the improvement of stevia [Stevia rebaudiana (Bertoni)]," Can J Plant Sci. 91:1-27 (2011).
Yao et al., "A genetic linkage map for Stevia rebaudiana," Genome 42:657-61 (1999).
Yazaki, "ABC transporters involved in the transport of plant secondary metabolites," FEBS Lett. 580(4):1183-91 (Feb. 2006).
Yu et al., "Bioconversion of ethyl 4-chloro-3-oxobutanoate by permeabilized fresh brewer's yeast cells in the presence of allyl bromide," J Ind Microbiol Biotechnol. 34(2)151-6 (2007).
Yuan et al., "Kinetics and activation parameters for oxidations of styrene by Compounds I from the cytochrome P450 (BM-3) (CYP102A1) heme domain and from CYP119," Biochemistry 48(38):9140-6 (Sep. 2009).
Zheng et al. "An efficient one-step site-directed and site-saturation mutagenesis protocol," Nucleic Acids Res. 32(14): e115 (Aug. 2004).
Zhu et al., "A multi-omic map of the lipid-producing yeast Rhodosporidium toruloides," Nature Commun. 3:1112 (Oct. 2012).
GenBank Accession No. AAF61439.1, dated Sep. 25, 2000 (2 pages).
GenBank Accession No. AAM53963.1, dated Jun. 17, 2002 (2 pages).
GenBank Accession No. AAR06918.1, dated Dec. 28, 2004 (2 pages).
GenBank Accession No. AAT93110.1, dated Apr. 24, 2007 (2 pages).
GenBank Accession No. ACE87855.1, dated Jun. 24, 2008 (1 page).
GenBank Accession No. ACM47734.1, dated Feb. 7, 2009 (1 page).
GenBank Accession No. ACT33422.1, dated Jul. 17, 2009 (1 page).
GenBank Accession No. AF515727.1, dated Jun. 17, 2002 (2 pages).
GenBank Accession No. AY345974.1, dated Dec. 28, 2004 (2 pages).
GenBank Accession No. AY345978.1, dated Dec. 28, 2004 (2 pages).
Genbank Accession No. AY345980.1, dated Dec. 28, 2004 (2 pages).
GenBank Accession No. AY345982.1, dated Dec. 28, 2004 (2 pages).
GenBank Accession No. BG521726.1, dated May 13, 2000 (2 pages).
GenBank Accession No. CAA23011.1, dated Oct. 23, 2008 (2 pages).
GenBank Accession No. CAA46815.1, dated Apr. 18, 2005 (2 pages).
GenBank Accession No. DQ269454.4, dated May 28, 2008 (2 pages).
GenBank Accession No. EU722415.1, dated Jun. 10, 2008 (2 pages).
GenBank Accession No. EU751291.1, dated Jun. 24, 2008 (2 pages).
EBI Accession No. AAY05902, "Jerusalem artichoke in-chain hydroxylase CYP8161" (1 page), Jun. 15, 2009.
EBI Accession No. ABM86477, "Rice abiotic stress responsive polypeptide SEQ ID No. 4723" (1 page), dated Jun. 2, 2005.
UniProt Accession No. F2DG34, May 2011 (pp. 1-4).
UniProt Accession No. Q6VAA8, 2004 (pp. 1-6).
UniProt Accession No. Q7FPQ4, 2004 (pp. 1-6).
GenBank Accession No. XM_001467423, dated Jul. 16, 2015 (2 pages).
GenBank Accession No. XP_002282091, dated Dec. 7, 2011 (1 page).
GenBank Accession No. XP_002288339, dated Jul. 15, 2009 (2 pages).
GenBank Accession No. XP_002311286, dated Dec. 31, 2013 (2 pages).
GenBank Accession No. ZP_05004570, dated Jun. 8, 2010 (2 pages).
Gossen & Bujard, "Studying gene function in eukaryotes by conditional gene inactivation," Annu. Rev. Genet. 36:153-73 (Jun. 2002).
Gritz & Davies, "Plasmid-encoded hygromycin B resistance: the sequence of hygromycin B phosphotransferase gene and its expression in Escherichia coli and Saccharomyces cerevisiae," Gene 25(2-3):179-88 (Nov. 1983).
Hallstrom & Moye-Rowley, "Divergent transcriptional control of multidrug resistance genes in Saccharomyces cerevisiae," J. Biol. Chem. 273(4):2098-104 (Jan. 1998).
Katzmann et al., "Expression of an ATP-binding cassette transporter-encoding gene (YOR1) is required for oligomycin resistance in Saccharomyces cerevisiae," Mol. Cell Biol. 15(12):6875-83 (Dec. 1995).
Li et al., "Phylogenetic analysis of the UDP-glycosyltransferase multigene family of Arabidopsis thaliana," J. Biol. Chem. 276(6):4338-43 (Oct. 2000).
Masada et al., "An efficient chemoenzymatic production of small molecule glucosides with in situ UDP-glucose recycling," FEBS Lett. 581(13):2562-6 (May 2007).
Morita et al., "Japanese morning glory dusky mutants displaying reddish-brown or purplish-gray flowers are deficient in a novel glycosylation enzyme for anthocyanin biosynthesis, UDP-glucose:anthocyanidin 3-O-glucoside-2"-O-glucosyltransferase, due to 4-bp insertions in the gene," Plant J. 42(3):353-63 (May 2005).
Nagy et al., "Role of the yeast ABC transporter Yor1p in cadmium detoxification," Biochimie 88(11):1665-71 (Jun. 2006).
Nikaido & Takatsuk, "Mechanisms of RND multidrug efflux pumps," Biochim. Biophys. Acta. 1794(5):769-81 (May 2009).

(56) References Cited

OTHER PUBLICATIONS

Osmani et al., "Catalytic key amino acids and UDP-sugar donor specificity of a plant glucuronosyltransferase, UGT94B1: molecular modeling substantiated by site-specific mutagenesis and biochemical analyses," Plant Physiol. 148(3):1295-308 (Nov. 2008).
Osmani et al., "Substrate specificity of plant UDP-dependent glycosyltransferases predicted from crystal structures and homology modeling," Phytochemistry 70(3):325-47 (Feb. 2009).
Richman et al., "Functional genomics uncovers three glucosyltransferases involved in the synthesis of the major sweet glucosides of Stevia rebaudiana," Plant J. 41(1):56-67 (Jan. 2005).
Riesmeier et al., "Isolation and characterization of a sucrose carrier cDNA from spinach by functional expression in yeast," EMBO J. 11(13):4705-13 (Dec. 1992).
Rodríguez-Concepción & Boronat, "Elucidation of the methylerythritol phosphate pathway for isoprenoid biosynthesis in bacteria and plastids. A metabolic milestone achieved through genomics," Plant Physiol. 130 (3):1079-89 (Nov. 2002).
Saier Jr et al., "The major facilitator superfamily," J. Mol. Microbiol. Biotechnol. 1(2):257-79 (Nov. 1999).
Saier Jr et al., "The Transporter Classification Database: recent advances," Nucleic Acids Res. 37:D274-8 (Jan. 2009).
Sauer et al., "The soluble and membrane-bound transhydrogenases UdhA and PntAB have divergent functions in NADPH metabolism of *Escherichia coli*," J. Biol. Chem. 279(8):6613-9 (Dec. 2003).
Sawada et al., "UDP-glucuronic acid:anthocyanin glucuronosyltransferase from red daisy (*Bellis perennis*) flowers. Enzymology and phylogenetics of a novel glucuronosyltransferase involved in flower pigment biosynthesis," J. Biol. Chem. 280(2):899-906 (Jan. 2005).
Shao et al., "Enhanced production of alpha-galactosyl epitopes by metabolically engineered Pichia pastoris," Appl. Environ. Microbiol. 69(9):5238-42 (Sep. 2003).
Son et al., "Production of flavonoid O-glucoside using sucrose synthase and flavonoid O-glucosyltransferase fusion protein," J. Microbiol. Biotechnol. 19(7):709-12 (Jul. 2009).
Sonnhammer et al., "Pfam: a comprehensive database of protein domain families based on seed alignments," Proteins 28(3):405-20 (Jul. 1997).
Sonnhammer et al., "Pfam: multiple sequence alignments and HMM-profiles of protein domains," Nucleic Acids Res. 26(1):320-2 (Jan. 1998).
Yadav et al., "Steviol Glycosides from Stevia: Biosynthesis Pathway Review and their Application in Foods and Medicine", Critical Reviews in Food Science and Nutrition, vol. 52, No. 11, pp. 988-998; (2012).
International Search Report by the International Searching Authority for International Application No. PCT/EP2014/052675, dated Apr. 23, 2014 (5 pages).
Written Opinion of the International Searching Authority for International Application No. PCT/EP2014/052675, dated Apr. 23, 2014 (7 pages).
Ceunen & Geuns, "Steviol glycosides: chemical diversity, metabolism, and function," J. Nat. Prod. 76(6):1201-28 (Jun. 2013).
Olsson et al., "Microbial production of next-generation stevia sweeteners," Microbial Cell Factories, 15:1-14 (2016).
Song et al., "The Aspergillus fumigatus 1-29 damage resistance protein family coordinately regulates ergosterol biosynthesis and azole susceptibility," MBIO, 7:1-13 (2016).
Liu et al., "Functional and Biochemical Characteritzation of *Escherichia coli* Sugar Efflux Transporters," JBC, 274 (33):22977-22984 (Aug. 1999).
Sun et al., "Regulation and Function of *Escherichia coli* Sugar Efflux Transporter A (Set A) during Glucose-Phosphate Stress," J of Bacteriology, 193(1):143-153 (Jan. 2011).
Garber et al., "Computational methods for transcriptome annotation and quantification using RNA-seq," Nat Methods 8(6):469-77 (2011).
Kawai et al., "Transformation of *Saccharomyces cerevisiae* and other fungi: methods and possible underlying mechanism," Bioeng Bugs. 1(6):395-403 (2010).
Lin et al., "Arrestin-related ubiquitin-ligase adaptors regulate endocytosis and protein turnover at the cell surface," Cell 135(4):714-25 (2008).
Nagalakshmi et al., "The transcriptional landscape of the yeast genome defined by RNA sequencing," Science 320 (5881 ): 1344-9 (2008).
Nikko & Pelham, "Arrestin-mediated endocytosis of yeast plasma membrane transporters," Traffic 10(12):1856-67 (2009).
Nikko et al. "Arrestin-like proteins mediate ubiquitination and endocytosis of the yeast metal transporter Smf1," EMBO Rep. 9(12):1216-21 (2008).
Olsson et al., "Microbial production of next-generation stevia sweeteners," Microbial Cell Factories, 15:11-14 (2016).
Partow et al., "Characterization of different promoters for designing a new expression vector in *Saccharomyces cerevisiae*," Yeast 27:955-64 (2010).
Robinson & Oshlack et al., "A scaling normalization method for differential expression analysis of RNA-seq data," Genome Bioi. 11(3):R25 (2010).
Saier Jr. et al., "The transporter classification database," Nucl. Acids Res., 42(1):D251-258 (2014).
Wang et al., "RNA-Seq: a revolutionary tool for transcriptomics," Nat Rev Genet. 10(1):57-63 (2009).
Wilhelm et al., "Defining transcribed regions using RNA-seq," Nature Protocols 5:255-66 (2010).
Yang Quanhua et.al., "Analysis of the Chemical constituents of Stevia rebaudiana and its sweetness," Journal of Beijing University of Chemical Technology, vol. 39, No. 2., p. 28-32 (2012) (English Abstract).
Abraham & Bhat, "Permeabilization of bakers yeast with N-lauroyl sarcosine," J Ind Microbial Biotechnol. 35 (8):799-804 (2008).
Ageitos et al., "Oily yeasts as oleaginous cell factories," Appl Microbiol Biotechnol. 90(4):1219-27 (May 2011).
Agrawal, "NMR spectroscopy in the structural elucidation of oligosaccharides and glycosides," Phytochemistry 31 (10):3307-30 (1992).
Ajikumar et al., "Terpenoids: opportunities for biosynthesis of natural product drugs using engineered microorganisms," Molecular Pharmaceuticals 5(2):167-90 (2008).
Alakomi et al., "Lactic acid permeabilizes gram-negative bacteria by disrupting the outer membrane," Appl Environ Microbiol. 66(5):2001-5 (2000).
Ali et al., "Biochemical investigation during different stages of in vitro propagation of Stevia rebaudiana," Pak J Bot. 42 (4):2827-37 (2010).
Bankar et al., "Environmental and industrial applications of Yarrowia lipolytica," Appl Microbiol Biotechnol. 84 (5):847-65 (Oct. 2009).
Baykov et al., "A malachite green procedure for orthophosphate determination and its use in alkaline phosphatase-based enzyme immunoassay," Anal Biochem. 171(2):266-70 (Jun. 1988).
Beopoulos et al., "Yarrowia lipolytica: A model and a tool to understand the mechanisms implicated in lipid accumulation," Biochimie 91(6):692-6 (Jun. 2009).
Brandle et al., "Leaf ESTs from Stevia rebaudiana: A Resource for Gene Discovery in Diterpene Synthesis," Plant Mol Biol. 50(4-5):613-22 (2002).
Brandle & Telmer, "Steviol glycoside biosynthesis," Phytochemistry 68(14):1855-63 (2007).
Brochado et al. "Improved vanillin production in baker's yeast through in silico design," Microb Cell Fact. 9:84-98 (2010).
Carretero-Paulet et al., "Expression and Molecular Analysis of the Arabidopsis DXR Gene Encoding 1-Deoxy-d-Xylulose 5-Phosphate Reductoisomerase, the First Committed Enzyme of the 2-C-Methyl-D-Erythritol 4-Phosphate Pathway," Plant Physiol. 129(4):1581-91 (2002).
Chemler et al., "Biosynthesis of isoprenoids, polyunsaturated fatty acids and flavonoids in *Saccharomyces cerevisiae*," Microb Cell Fact. 5:20 (2006).
Chen, "Summary on Study of Stevioside," China Pharmacist, 10(6):598-599 (2007).
Chen et al., "MolProbity: all-atom structure validation for macromolecular crystallography," Acta Crystallogr D Biol Crystallogr 66(Pt 1):12-21 (Jan. 2010).

(56) References Cited

OTHER PUBLICATIONS

Chica et al., "Semi-rational approaches to engineering enzyme activity: combining the benefits of directed evolution and rational design," Curr Opin Biotechnol. 16(4):378-84 (2005).
Chow & Palecek, "Enzyme encapsulation in permeabilized *Saccharomyces cerevisiae* cells," Biotechnol Prog. 20 (2):449-56 (2004).
Correa et al., "Genetic mapping of 1,3-beta-glucanase-encoding genes in *Saccharomyces cerevisiae*," Current Genet. 22(4):283-8 (1992).
Darise et al., "Enzymic Transglucosylation of Rubusoside and the Structure-Sweetness Relationship of Steviol-Bisglycosides," Agric. Biol. Chem. 48(10):2483-8 (Jan. 1984).
Davis et al., "MolProbity: all-atom contacts and structure validation for proteins and nucleic acids," Nucleic Acids Res. 35:W375-83 (Apr. 2007).
Del Sorbo et al., "Fungal transporters involved in efflux of natural toxic compounds and fungicides," Fungal. Genet. Biol. 30(1):1-15 (Jun. 2000).
Diener et al., "*Arabidopsis* ALF5, a multidrug efflux transporter gene family member, confers resistance to toxins," Pant Cell 13(7):1625-38 (Jul. 2001).
Dodhia et al., "Engineering human cytochrome P450 enzymes into catalytically self-sufficient chimeras using molecular Lego," J Biol Inorg Chem. 11(7):903-16 (Oct. 2006).
Dubey, et al., An overview of the non-mevalonate pathway for terpenoid biosynthesis in plants, J. Biosci. 28 (5):637-46 (2003).
Dubois & Stephenson, "Diterpenoid sweeteners. Synthesis and sensory evaluation of stevioside analogues with improved organoleptic properties," J. Med. Chem. 28(1):93-8 (Jan. 1985).
EFSA Panel on Food Additives and Nutrient Sources added to Food (ANS), "Scientific Opinion on the safety of steviol glycosides for the proposed uses as a food additive," EFSA Journal 8(4):1537 (2010).
Eisenreich et al., "Biosynthesis of isoprenoids via the non-mevalonate pathway," Cell Mol Life Sci. 61(12):1401-6 (2004).
EMBOSS Needle results for Pairwise Sequence Alignment of UGT91D1 and UGT91D2; dated Apr. 4, 2016, 2 pages.
Emmerstorfer et al., "Over-expression of ICE2 stabilizes cytochrome P450 reductase in *Saccharomyces cerevisiae* and Pichia pastoris," Biotechnol J. 10(4):623-35 (Apr. 2015).
Estrada De Martin et al., "Ice2p is important for the distribution and structure of the cortical ER network in *Saccharomyces cerevisiae*," J Cell Sci. 118(Pt 1):65-77 (Oct. 2006).
Fernandez et al., "Activation of chitin synthetase in permeabilized cells of a *Saccharomyces cerevisiae* mutant lacking proteinase B," J Bacteriol. 152(3):1255-64 (1982).
Flores et al., "Permeabilization of yeast cells (*Kluyveromyces lactis*) with organic solvents," Enzyme Microb Technol. 16(4):340-6 (1994).
Fowler & Zabin, "Effects of Dimethylsulfoxide on the Lactose Operon in *Escherichia coli*," J Bacteriol. 92(2):353-7 (1966).
Freire, "Differential scanning calorimetry," Methods Mol Biol. 40:191-218 (1995).
Fukunaga et al., "Enzymatic transglucosylation products of stevioside: separation and sweetness-evaluation," Agric. Biol. Chem. 53(6):1603-7 (Jan. 1989).
Geuns, "Stevioside," Phytochemistry 64(5):913-21 (2003).
Giaever & Nislow, "The yeast deletion collection: a decade of functional genomics," Genetics 197(2):451-65 (Jun. 2014).
Getz & Schiestl, "High-efficiency yeast transformation using the LiAc/SS carrier DNA/PEG method," Nat Protoc. 2 (1):31-4 (2007).
Girvan et al., "Flavocytochrome P450 BM3 mutant W1046A is a NADH-dependent fatty acid hydroxylase: implications for the mechanism of electron transfer in the P450 BM3 dimer," Arch Biochem Biophys. 507(1):75-85 (Mar. 2011).
Goralczyk, "Compounds from Stevia for Improving and Maintaining Mental Performance," Stevia World Forum, Feb. 24-25, 2010, 17 pages.
Guleria & Yadav, "Insights into Steviol Glycoside Biosynthesis Pathway Enzymes Through Structural Homology Modeling," Am. J. Biochem. Molec. Biol. 3(1):1-19 (2013).

Gunel et al., "Metabolic Engineering for Production of Geranylgeranyl Pyrophosphate Synthase in Non-Carotenogenic Yeast *Schizosaccharomyces pombe*," Biotechnol. & Biotechnol. Eq. 20(3):76-82 (2006).
Hansen et al., "De novo biosynthesis of vanillin in fission yeast (*Schizosaccharomyces pombe*) and baker's yeast (*Saccharomyces cerevisiae*)," Appl Environ Microbiol. 75(9):2765-74 (2009).
Hansen et al., "Versatile Enzyme Expression and Characterization System for Aspergillus nidulans, with the Penicillium brevicompactum Polyketide Synthase Gene from the Mycophenolic Acid Gene Cluster as a Test Case," Appl Environ Microbiol. 77(9):3044-51 (2011).
Hellfritsch et al., "Human psychometric and taste receptor responses to steviol glycosides," J. Agric. Food Chem. 60(27):6782-93 (Jul. 2012).
Humphrey et al., "Spatial organisation of four enzymes from Stevia rebaudiana that are involved in steviol glycoside synthesis," Plant Mol Bio. 61(1-2):47-62 (2006).
Iandolino et al., " High-Quality RNA, cDNA, and Derived EST Libraries From Grapevine (*Vitis vinifera* L.)," Plant Mol Biol Reporter 22:269-78 (2004).
Irmler et al., "Indole alkaloid biosynthesis in Catharanthus roseus: new enzyme activities and identification of aytochrome P450 CYP72A1 as secologanin synthase," Plant J. 24(6):797-804 (2000).
Jennewein et al., "Taxol biosynthesis: baxane 13 alpha-hydroxylase is a cytochrome P450-dependent monooxygenase," Proc Natl Acad Sci U S A 98(24):13595-600 (2001).
Jewett et al. "An integrated cell-free metabolic platform for protein production and synthetic biology," Mol Syst Biol. 4:220 (2008).
Johnstone et al., "Cloning an Aspergillus nidulans developmental gene by transformation," EMBO J. 4(5):1307-11 (1985).
Khoury et al., "Computational design of Candida boidinii xylose reductase for altered cofactor specificity," Protein Sci. 18(10):2125-38 (Oct. 2009).
Kim et al., "Hydroxylation of ent-Kaurenoic Acid to Steviol in Stevia rebaudiana Bertoni—Purification and Partial Characterization of the Enzyme," Arch Biochem Biophys. 332(2):223-30 (1996).
Kim & Shibata, "Characterization of ent-kaurenoic acid 13-hydroxylase in steviol biosynthesis of Stevia rebaudiana Bertoni," Journal of the Korean Agriculturalchemical Society 40(6):501-7 (1997).
Knowles et al., "Genetic Transformation and Plant Regeneration in Stevia rebaudiana Using Microprojectile Bombardment," In Vitro Cellular & Developmental Biology 39(abstract):23-A (2003).
Kohda et al., "New Sweet Diterpene glucoside from Stevia Rebaudiana," Phytochemistry 15(6):981-3 (1976).
Kondo et al., "Preparation of high activity whole cell biocatalyst by permeabilization of recombinant flocculent yeast with alcohol," Enzyme Microb Technol. 27(10),806-11 (2000).
Kumar et al., "A comprehensive analysis of fifteen genes of steviol glycosides biosynthesis pathwayin Stevia rebaudiana (Bertoni)" Gene 492:276-84 (Epub Oct. 20, 2011).
Kusama et al., "Transglucosylation into stevioside by the enzyme system from *Streptomyces* sp.," Agric. Biol. Chem. 50(10):2445-51 (Oct. 1986).
Li et al., "Crystal structure of Medicago truncatula UGT85H2—insights into the structural basis of a multifunctional (iso) flavonoid glycosyltransferase," J Mol Biol. 370(5):951-63 (2007).
Li et al., "Systematic Mutational Analysis of Peptide Inhibition of the p53-MDM2/MDMX," J Mol Biol. 398(2):200-13 (2010).
Li et al., "High-density cultivation of oleaginous yeast *Rhodosporidium toruloides* Y4 in fed-batch culture," Enzyme and Microbial Technology 41(3):312-7 (Aug. 2007).
Liu et al., "Preparation of high-activity whole cell biocatalysts by permeabilization of recombinant yeasts with alcohol," J Biosci Meng. 89(6):554-8 (2000).
Ma et al., "Molecular cloning and characterization of Stevia Rebaudiana UDP-glucosyltransferase," Acta Biologiae Experimentalis Sinica 36(2):123-9 (2003).
Ma "Part 1. Molecular Cloning and Functional Analysis of UDPG Glucosyltransferase Gene. Part 2. Molecular Cloning, Sequence Analysis and Evolution of Actin and EF1a Genes in Stevia Rebaudiana." Chinese Doctor and Master Dissertations Full-Text Database, Agricultural Technology Part, vol. 2; pp. 1-74 (2004).

(56) References Cited

OTHER PUBLICATIONS

Madan et al., "Stevia rebaudiana (Bert.) Bertoni—A Review," Indian Journal of Natural Products and Resources 1 (3)267-86 (2010).
Madhav et al., "Functional and structural variation of uridine diphosphate glycosyltransferase (UGT) gene of Stevia rebaudiana—UGTSr involved in the synthesis of rebaudioside A," Plant Physiol. Biochem. 63:245-53 (Feb. 2013).
Malonek et al., "The NADPH-cytochrome P450 Reductase Gene from Gibberalla fujikuroi is Essential for Gibberellin Biosynthesis," J Bio Chem. 279(24):25075-84 (2004).
Mantovaneli et al., "The effect of temperature and flow rate on the clarification of the aqueous stevia-extract in a fixed-bed columns with zeolites," Braz J Chem Eng. 21(3):449-58 (2004).
Mattanovich et al., "Recombinant protein production in yeasts," Methods Mol Biol. 824:329-58 (2012).
Megeji et al., "Introducing *Stevia rebaudiana*, a natural zero-calorie sweetener," Current Science 88(5):801-4 (2005).
Mohamed et al., "UDP-dependent glycosyltransferases involved in the biosynthesis of steviol glycosides" Journal of Plant Physiology 168(10):1136-1141 (Jul. 2011; Epub Apr. 7, 2011).
Mumberg et al., "Yeast vectors for the controlled expression of heterologous proteins in different genetic backgrounds," Gene 156(1):119-22 (1995).
Naesby et al., "Yeast artificial chromosomes employed for random assembly of biosynthetic pathways and production of diverse compounds in *Saccharomyces cerevisiae*," Microb Cell Fact. 8:45 (2009).
Naglak & Wang, "Rapid protein release from *Escherichia coli* by chemical permeabilization under fermentation conditions," Biotechnol Bioeng. 39(7):732-40 (1991).
Nakagiri et al., "cDNA cloning, functional expression and characterization of ent-copalyl diphosphate synthase from *Scoparia dulcis* L," Plant Sci. 169:760-7 (2005).
Nelson et al., "P450 superfamily: update on new sequences, gene mapping, accession numbers and nomenclature," Pharmacogenetics 6:1-42 (1996).
Newman et al., "High-level production of amorpha-4,11-diene in a two-phase partitioning bioreactor of metabolically engineered *Escherichia coli*," Biotechnol Bioeng 95(4):684-91 (2006).
Nicaud, "Yarrowia lipolytica," Yeast 29(10):409-18 (Oct. 2012).
Nielsen et al., "Efficient PCR-based gene targeting with a recyclable marker for Aspergillus nidulans," Fungal Genet Biol. 43(1):54-64 (2006).
Nour-Eldin et al., "USER cloning and USER fusion: the ideal cloning techniques for small and big laboratories," Methods Mol Biol. 643:185-200 (2010).
Ohta et al., "Characterization of Novel Steviol Glycosides from Leaves of Stevia rebaudiana Morita," J. Applied Glycosides 57(3):199-209 (Mar. 2010).
Ohta et al., MassBank Accession No. FU000341 (May 2011).
Ohta et al., MassBank Accession No. FU000342 (May 2011).
Ohta et al., MassBank Accession No. FU000343 (May 2011).
Ohtani et al., "Further Study on the 1,4-alpha-Transglucosylation of Rubusoside, a Sweet Steviol-Bisglucoside from Rubus suavissimus," Agric Biol Chem. 55(2):449-53 (1991).
Oka & Jigami, "Reconstruction of de novo pathway for synthesis of UDP-glucuronic acid and UDP-xylose from Intrinsic UDP-glucose in *Saccharomyces cerevisiae*," FEBS J. 273(12):2645-57 (2006).
Orihara et al., "Biotransformation of steviol by cultured cells of eucalyptus perriniana and Coffea Arabica," Phytochemistry 30(12):3989-92 (1991).
Paradise et al., "Redirection of flux through the FPP branch-point in *Saccharomyces cerevisiae* by down-regulating squalene synthase," Biotechnol Bioeng. 100(2):371-8 (2008).
Pearson & Lipman, "Improved tools for biological sequence comparison," Proc Natl Acad Sci. 85(8):2444-8 (1998).
Piirainen et al., "Glycoengineering of yeasts from the perspective of glycosylation efficiency," N Biotechnol. 31 :6):532-7 (Dec. 2014).
Pompon et al., "Yeast Expression of Animal and Plant P450s in Optimized RedoxEnvironments," Methods Enzymol 272:51-64 (1996).
Prelich, "Gene overexpression: uses, mechanisms, and interpretation," Genetics 190(3):841-54 (Mar. 2012).
Presecki & Vasic-Racki, "Production of L-malic acid by permeabilized cells of commercial *Saccharomyces* sp. strains," Biotechnol Lett. 27(23-24):1835-9 (2005).
Ro et al., "Production of the antimalarial drug precursor artemisinic acid in engineered yeast," Nature 440(7086):940-3 (2006).
Saenge et al., "Potential use of oleaginous red yeast *Rhodotorula glutinis* for the bioconversion of crude glycerol from biodiesel plant to lipids and carotenoids," Process Biochemistry 46(1):210-8 (Jan. 2011).
Schwab et al., Poster, "Watchmakers Compound Generation by Combinatorial Genetics and Screening in Yeast," 141st Annual Conference in St. Louis, 2008, 1 page.
Sen et al., "Developments in Directed Evolution for Improving Enzyme Functions," Appl Biochem Biotechnol.143 (3):212-23 (2007).
Senthilraja et al., "RNA secondary structure prediction: Analysis of *Saccharomyces cerevisiae* RNAs," Int. J. Pharm. Rev. Res. 25(2):287-91 (Mar.-Apr. 2014).
Bateman et al., "Pfam 3.1: 1313 multiple alignments and profile HMMs match the majority of proteins," Nucleic Acids Res. 27(1):260-2 (Jan. 1999).
Bay & Turner, "Diversity and evolution of the small multidrug resistance protein family," BMC Evol. Biol. 9:140 (Jun. 2009).
Brachmann et al., "Designer deletion strains derived from *Saccharomyces cerevisiae* S288C: a useful set of strains and plasmids for PCR-mediated gene disruption and other applications," Yeast 14:115-32 (1998).
Chen et al., "Transferring a biosynthetic cycle into a productive *Escherichia coli* strain: large-scale synthesis of galactosides," J. Am. Chem. Soc. 123(36):8866-7 (Sep. 2001).
Chenna et al., "Multiple sequence alignment with the Clustal series of programs," Nucleic Acids Res. 31 (13):3497-500 (Jul. 2003).
Diener et al., "*Arabidopsis* ALF5, a multidrug efflux transporter gene family member, confers resistance to toxins," Plant Cell 13(7):1625-38 (Jul. 2001).
GenBank Accession No. AAB62280, dated Jul. 2, 1997 (2 pages).
GenBank Accession No. AAB87091, dated Mar. 22, 2000 (2 pages).
GenBank Accession No. AAC28895.1, dated Aug. 6, 1998 (2 pages).
GenBank Accession No. AAC39505, dated Jul. 26, 1998 (1 page).
GenBank Accession No. AAD34294, dated Mar. 22, 2000 (2 pages).
GenBank Accession No. AAD34295, dated Mar. 22, 2000 (2 pages).
GenBank Accession No. AAD47596, dated Aug. 9, 1999 (2 pages).
GenBank Accession No. AAH69913, dated Jul. 15, 2006 (2 pages).
GenBank Accession No. AEE36246, dated Oct. 6, 2014 (3 pages).
GenBank Accession No. AAR06912, dated Dec. 28, 2004 (2 pages).
GenBank Accession No. AAR06916.1, dated Dec. 28, 2004 (2 pages).
GenBank Accession No. AAR06920.1, dated Dec. 28, 2004 (2 pages).
GenBank Accession No. ABA42921, dated Jun. 21, 2006 (1 page).
GenBank Accession No. ABB88839, dated May 28, 2008 (2 pages).
GenBank Accession No. ABC59076, dated Jun. 6, 2007 (1 page).
GenBank Accession No. ABC98596, dated Jan. 31, 2014 (2 pages).
GenBank Accession No. ABD60225, dated May 28, 2008 (2 pages).
GenBank Accession No. ABD92926, dated Oct. 10, 2007 (2 pages).
GenBank Accession No. AC133334, dated Jan. 31, 2004 (44 pages).
GenBank Accession No. ACD93722, dated Jun. 10, 2008 (1 page).
GenBank Accession No. AF034774, dated Apr. 17, 1998 (2 pages).
GenBank Accession No. AY562490, dated May 23, 2006 (3 pages).
GenBank Accession No. BAA43200, dated Mar. 13, 1999 (2 pages).
GenBank Accession No. BAB59027, dated Jan. 30, 2002 (1 page).
GenBank Accession No. BAF61135, dated May 9, 2007 (2 pages).
GenBank Accession No. BAG30962, dated Nov. 12, 2012 (2 pages).
GenBank Accession No. BC153262, dated Oct. 4, 2007 (3 pages).
GenBank Accession No. CAA75568, dated Nov. 14, 2006 (2 pages).
GenBank Accession No. CAA76703, dated Nov. 14, 2006 (1 page).
GenBank Accession No. CAE09055, dated Nov. 14, 2006 (2 pages).
GenBank Accession No. CAG41604, dated Feb. 6, 2015 (2 pages).

(56) References Cited

OTHER PUBLICATIONS

GenBank Accession No. DQ398871.3, dated May 28, 2008 (2 pages).
GenBank Accession No. EDY51667, dated Sep. 2, 2008 (2 pages).
GenBank Accession No. EU263989, dated Jun. 11, 2008 (2 pages).
GenBank Accession No. NM_116512, dated Jan. 22, 2014 (3 pages).
GenBank Accession No. NP_001105097, dated Aug. 4, 2015 (2 pages).
GenBank Accession No. NP_013636.1 (YML075C), dated Jul. 16, 2015 (3 pages).
GenBank Accession No. NP_194183, dated Jan. 22, 2014 (4 pages).
GenBank Accession No. NP_195399, dated Jan. 22, 2014 (3 pages).
GenBank Accession No. NP_197872.1, dated Jan. 22, 2014 (2 pages).
GenBank Accession No. Q9UVY5.1, dated Apr. 1, 2015 (3 pages).
Praveen Guleria, et al., "Insights into steviol glycoside biosynthesis pathway enzymes through structural homology modeling", American Journal of Biochemistry and Molecular Biology, vol. 3:1-19 (2013).
Jianfeng Wang, et al., "Design and construction of artificial biological systems for complex natural products biosynthesis", Chinese Journal of Biotechnology, vol. 29:1146-1160 (20130.
Yong-Heng Yang, et al, "Base substitution mutations in uridinediphosphate-dependent glycosyltransferase 76G1 gene of Stevia rebaudiana causes the low levels of rebaudioside A; mutations in UGT76G1, a key gene of steviol glycoside synthesis", Plant Physiology and Biochemistry, vol. 80:220-225 (2014).
Bruyn et al., "Metabolic engineering of Escherichia coli into a versatile glycosylation platform: production of bio-active quercetin glycosides," Microb Cell Fact., 14:138 (2015).
Bruyn et al., "Development of an in vivo glucosylation platform by coupling production to growth: production of phenolic glucosides by a glycosyltransferase of Vitis vinifera," Biotechnol Bioeng., 112(8):1594-603 (2015).
Duetz, "Microtiter plates as mini-bioreactors: miniaturization of fermentation methods," Trends Microbiol 15 (10):469-75 (2007).
François et al., "Reserve carbohydrates metabolism in the yeast Saccharomyces cerevisiae," FEMS Microbiol Rev., 25(1):125-45 (2001).
Li et al., "Production of rebaudioside A from stevioside catalyzed by the engineered Saccharomyces cerevisiae," Appl Biochem Biotechnol., 178(8):1586-98 (2016).
UniParc Accession No. UPI000006C207 (Q06625), Feb. 1, 2005 (9 pages).
Chen et al., "Progress in the Application of Affinity Tags for the Expression and Purification of Recombinant Proteins,", China Biotechnology, vol. 32, No. 12, pp. 93-103, Dec. 15, 2012 (English Abstract).
Ohta et al., MassBank Accession No. FU000299 (May 2016).
Ohta et al., MassBank Accession No. FU000332 (May 2016).
Tiwari et al., "Plant secondary metabolism linked glycosyltransferases: An update on expaning knowledge and scopes", Biotechnology Advances, 34:714-739 (May 2016).
Third Party Submission in U.S. Appl. No. 14/648,747; dated Mar. 28, 2016, pp. 1-231.
International Search Report and Written Opinion of the International Searching Authority for International Application No. PCT/EP2017/061775; dated Sep. 6, 2017, pp. 1-17.
International Preliminary Report on Patentability from the International Bureau for International Application PCT/EP2017/061775; dated Nov. 20, 2018 (pp. 1-9).
International Preliminary Report on Patentability from the International Bureau for International Application PCT/EP2015/070620; dated Mar. 14, 2017 (pp. 1-25).
International Preliminary Report on Patentability from the International Bureau for International Application PCTEP2015/068314; dated Feb. 14, 2017 (pp. 1-10).
International Search Report and Written Opinion of the International Searching Authority for International Application No. PCT/EP2015/052007; dated Jul. 4, 2016, pp. 1-24.
International Preliminary Report on Patentability from the International Bureau for International Application PCT/EP2015/052007; dated Aug. 1, 2017 (pp. 1-16).
International Search Report and Written Opinion of the International Searching Authority for International Application No. PCT/EP2016/068259; dated Jan. 24, 2017, pp. 1-18.
International Preliminary Report on Patentability from the International Bureau for International Application PCT/EP2016/068259; dated Feb. 13, 2018 (pp. 1-11).
International Search Report and Written Opinion of International Search Authority for International Application No. PCTEP2016/080516; dated Mar. 15, 2017, pp. 1-22.
International Preliminary Report on Patentability from the International Bureau for International Application PCTEP2016/080516; dated Jun. 12, 2018 (pp. 1-11).
International Search Report and Written Opinion of International Search Authority for International Application No. PCTEP2017/059028; dated Jun. 27, 2017, pp. 1-15.
International Preliminary Report on Patentability from the International Bureau for International Application PCTEP2017/059028; dated Oct. 16, 2018 (pp. 1-7).
International Search Report of the International Searching Authority for International Application No. PCT/EP2017/061774; dated Aug. 30, 2017, pp. 1-20.
Written Opinion of the International Searching Authority for International Application No. PCT/EP2017/061774; dated Aug. 30, 2017, pp. 1-13.
International Preliminary Report on Patentability from then International Search Authority for International Application No. PCT/EP2017/061774; dated Nov. 20, 2018, pp. 1-14.

* cited by examiner

Kaurenoic Acid+3Glc (isomer 1)

Figure 15B

Kaurenoic Acid+3Glc (isomer 1)

$^1$H NMR (800 MHz, DMSO $d_6$) δ ppm 0.74 - 0.81 (m, 1 H) 0.83 - 0.90 (m, 3 H) 0.97 (td, J=13.33, 4.16 Hz, 1 H) 1.02 - 1.10 (m, 3 H) 1.15 (s, 3 H) 1.30 - 1.44 (m, 3 H) 1.44 - 1.50 (m, 1 H) 1.50 - 1.62 (m, 3 H) 1.72 - 1.87 (m, 4 H) 1.91 - 1.99 (m, 2 H) 2.06 (d, J=17.12 Hz, 1 H) 2.16 (d, J=12.72 Hz, 1 H) 2.59 (br. s., 1 H) 2.98 - 3.06 (m, 2 H) 3.07 - 3.15 (m, 4 H) 3.16 - 3.26 (m, 3 H) 3.30 - 3.33 (m, 1 H) 3.42 (dd, J=11.00, 5.14 Hz, 1 H) 3.44 - 3.49 (m, 1 H) 3.50 - 3.55 (m, 1 H) 3.60 - 3.67 (m, 2 H) 3.68 - 3.75 (m, 3 H) 4.31 (d, J=7.82 Hz, 1 H) 4.34 - 4.37 (m, 1 H) 4.41 (t, J=5.38 Hz, 1 H) 4.48 (t, J=5.62 Hz, 1 H) 4.72 (s, 1 H) 4.78 (br. s., 1 H) 4.93 (d, J=5.38 Hz, 1 H) 4.96 - 5.02 (m, 3 H) 5.04 (d, J=7.83 Hz, 1 H) 5.12 (d, J=5.38 Hz, 1 H) 5.18 (d, J=2.45 Hz, 1 H) 5.43 (d, J=7.83 Hz, 1 H) 5.52 (d, J=2.45 Hz, 1 H)

$^{13}$C NMR (201.21 MHz, DMSO $d_6$) δ ppm 175.4 (1C), 155.3 (1C), 104.6 (1C), 103.6 (1C), 99.8 (1C), 92.4 (1C), 83.4 (1C), 77.6 (1C), 77.5 (1C), 77.2 (1C), 76.9 (1C), 76.2 (1C), 76.1 (1C), 75.8 (1C), 75.2 (1C), 70.8 (1C), 70.0 (1C), 69.8 (1C), 61.5 (1C), 61.4 (1C), 60.6 (1C), 56.7 (1C), 54.6 (1C), 48.7 (1C), 43.9 (1C), 43.4 (1C), 43.3 (1C), 41.2 (1C), 40.4 (1C), 40.0 (1C), 39.4 (1C), 37.8 (1C), 32.9 (1C), 28.5 (1C), 21.6 (1C), 19.1 (1C), 18.5 (1C), 16.1 (1C)

| Atom1 | Shift1 (ppm) | H's | Type | J (Hz) | Multiplet1 | (ppm) |
|---|---|---|---|---|---|---|
| 55<'> | 0.78 | 1 | m | - | M34 | [0.74...0.81] |
| 57 | 0.86 | 3 | m | - | M33 | [0.83...0.90] |
| 53<'> | 0.97 | 1 | td | 13.33, 4.16 | M32 | [0.92...1.00] |
| 13a, 2a, 10<'> | 1.07 | 3 | m | - | M31 | [1.02...1.10] |
| 52 | 1.15 | 3 | s | - | M30 | [1.12...1.18] |
| 11<'>, 4<'>, 54<'> | 1.38 | 3 | m | - | M29 | [1.30...1.44] |
| 11<'> | 1.47 | 1 | m | - | M28 | [1.44...1.50] |
| 4<'>, 3 | 1.56 | 3 | m | - | M27 | [1.50...1.62] |
| 55<'>, 12, 54<''> | 1.79 | 4 | m | - | M26 | [1.72...1.87] |
| 10<'>, 8<'> | 1.95 | 2 | m | - | M25 | [1.91...1.99] |
| 8<'> | 2.06 | 1 | d | 17.12 | M24 | [2.02...2.08] |
| 53<''> | 2.16 | 1 | d | 12.72 | M23 | [2.12...2.19] |
| 5a | 2.59 | 1 | br. s. | - | M22 | [2.57...2.61] |
| 38<ax>, 26<ax> | 3.02 | 2 | m | - | M14 | [2.98...3.06] |
| 30<ax>, 40<ax>, 28<ax>, 32<ax> | 3.10 | 4 | m | - | M15 | [3.07...3.15] |
| 46<ax>, 23<ax>, 48<ax> | 3.22 | 3 | m | - | M16 | [3.16...3.26] |
| 36<ax> | 3.32 | 1 | m | - | M21 | [3.30...3.33] |
| 33<'> | 3.42 | 1 | dd | 11.00, 5.14 | M35 | [3.41...3.43] |
| 49<'> | 3.46 | 1 | m | - | M20 | [3.44...3.49] |
| 41<'> | 3.52 | 1 | m | - | M19 | [3.50...3.55] |
| 44<ax>, 49<'> | 3.64 | 2 | m | - | M18 | [3.60...3.67] |
| 41<'>, 33<'>, 20<ax> | 3.71 | 3 | m | - | M17 | [3.68...3.75] |
| 25<ax> | 4.31 | 1 | d | 7.82 | M11 | [4.28...4.33] |
| 50 | 4.35 | 1 | m | - | M10 | [4.34...4.37] |
| 42 | 4.41 | 1 | t | 5.38 | M09 | [4.39...4.43] |
| 34 | 4.48 | 1 | t | 5.62 | M08 | [4.45...4.51] |
| 58<a> | 4.72 | 1 | s | - | M07 | [4.69...4.74] |
| 58<b> | 4.78 | 1 | br. s. | - | M06 | [4.76...4.81] |
| 31 | 4.93 | 1 | d | 5.38 | M13 | [4.91...4.95] |
| 27, 39, 29 | 4.99 | 3 | m | - | M12 | [4.96...5.02] |
| 22<ax> | 5.04 | 1 | d | 7.83 | M05 | [5.02...5.06] |
| 47 | 5.12 | 1 | d | 5.38 | M04 | [5.09...5.14] |
| 45 | 5.18 | 1 | d | 2.45 | M03 | [5.15...5.21] |
| 19<ax> | 5.43 | 1 | d | 7.83 | M02 | [5.40...5.46] |
| 37 | 5.52 | 1 | d | 2.45 | M01 | [5.49...5.54] |

Kaurenoic Acid+3Glc (isomer 1)

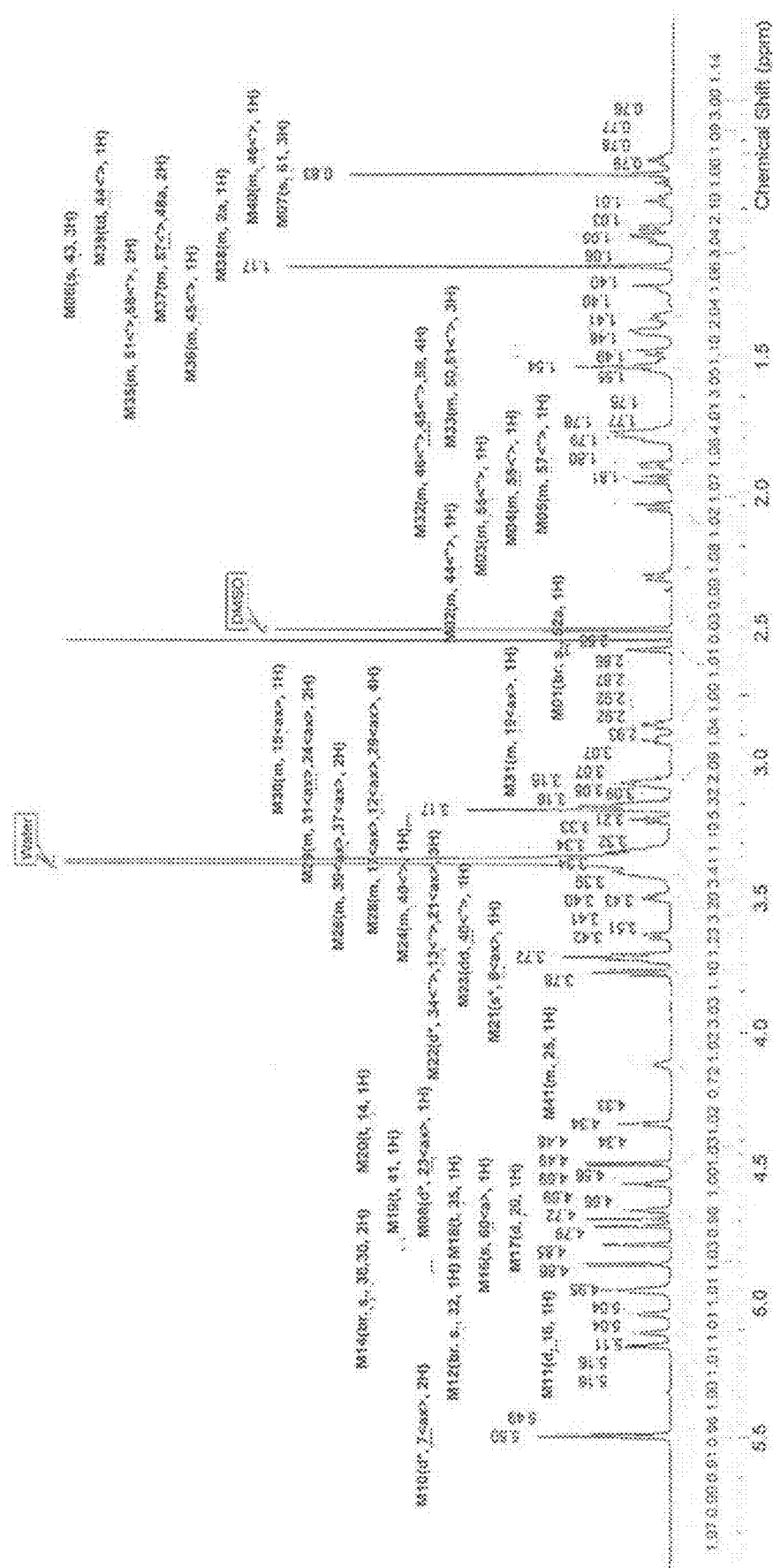

Figure 15E

Kaurenoic Acid+3Glc (isomer 2)

¹H NMR (800 MHz, DMSO $d_6$) δ ppm 0.73 - 0.80 (m, 1 H) 0.83 (s, 3 H) 0.92 (td, $J$=13.33, 4.16 Hz, 1 H) 1.00 - 1.04 (m, 1 H) 1.04 - 1.10 (m, 2 H) 1.17 (s, 3 H) 1.33 - 1.38 (m, 1 H) 1.38 - 1.44 (m, 2 H) 1.49 (d, $J$=12.72 Hz, 1 H) 1.51 - 1.59 (m, 3 H) 1.75 - 1.83 (m, 4 H) 1.88 - 1.93 (m, 1 H) 1.93 - 1.98 (m, 1 H) 2.03 - 2.09 (m, 1 H) 2.27 - 2.34 (m, 1 H) 2.58 (br. s., 1 H) 2.83 - 2.88 (m, 1 H) 2.89 - 2.95 (m, 1 H) 3.04 - 3.10 (m, 2 H) 3.12 - 3.19 (m, 4 H) 3.19 - 3.23 (m, 1 H) 3.30 - 3.35 (m, 2 H) 3.39 - 3.44 (m, 2 H) 3.47 - 3.53 (m, 1 H) 3.64 (dd, $J$=10.51, 4.16 Hz, 1 H) 3.73 (d, $J$=7.83 Hz, 3 H) 3.78 (s, 1 H) 4.09 - 4.14 (m, 1 H) 4.34 (t, $J$=5.14 Hz, 1 H) 4.48 (d, $J$=7.83 Hz, 1 H) 4.56 (t, $J$=5.62 Hz, 1 H) 4.66 (t, $J$=4.89 Hz, 1 H) 4.69 (d, $J$=2.45 Hz, 1 H) 4.72 (s, 1 H) 4.79 (br. s., 1 H) 4.86 (d, $J$=7.83 Hz, 1 H) 4.95 (br. s., 2 H) 5.04 (d, $J$=4.89 Hz, 1 H) 5.11 (br. s., 1 H) 5.16 (d, $J$=6.36 Hz, 1 H) 5.49 (d, $J$=8.31 Hz, 2 H)

¹³C NMR (201.21 MHz, DMSO $d_6$) δ ppm 175.1 (1C), 155.4 (1C), 103.7 (1C), 103.2 (1C), 101.5 (1C), 92.1 (1C), 86.8 (1C), 77.9 (1C), 77.3 (1C), 77.1 (1C), 77.0 (1C), 76.8 (1C), 74.4 (1C), 73.9 (1C), 71.2 (1C), 70.2 (1C), 68.2 (1C), 61.8 (1C), 61.1 (1C), 60.6 (1C), 56.7 (1C), 54.6 (1C), 48.8 (1C), 44.0 (1C), 43.6 (1C), 43.4 (1C), 41.1 (1C), 40.0 (1C), 39.5 (1C), 39.4 (1C), 37.1 (1C), 32.8 (1C), 28.4 (1C), 21.6 (1C), 19.3 (1C), 18.2 (1C), 16.2 (1C)

| Atom1 | Shift1 (ppm) | H's | Type | J (Hz) | Multiplet1 | (ppm) |
|---|---|---|---|---|---|---|
| 46<''> | 0.77 | 1 | m | - | M40 | [0.73 .. 0.80] |
| 61 | 0.83 | 3 | s | - | M07 | [0.81 .. 0.85] |
| 44<''> | 0.92 | 1 | td | 13.33, 4.16 | M39 | [0.89 .. 0.96] |
| 2a | 1.03 | 1 | m | - | M38 | [1.00 .. 1.04] |
| 57<'>, 48a | 1.07 | 2 | m | - | M37 | [1.04 .. 1.10] |
| 43 | 1.17 | 3 | s | - | M06 | [1.13 .. 1.21] |
| 45<'> | 1.36 | 1 | m | - | M36 | [1.33 .. 1.38] |
| 51<'>, 58<'> | 1.40 | 2 | m | - | M35 | |
| 58<''> | 1.49 | 1 | d | 12.72 | M34 | |
| 50, 51<''> | 1.54 | 3 | m | - | M33 | |
| 46<''>, 45<''>, 59 | 1.78 | 4 | m | - | M32 | |
| 57<''> | 1.90 | 1 | m | - | M05 | |
| 55<''> | 1.95 | 1 | m | - | M04 | |
| 55<'''> | 2.06 | 1 | m | - | M03 | |
| 44<'> | 2.31 | 1 | m | - | M02 | |
| 52a | 2.58 | 1 | br. s. | - | M01 | |
| 19<ax> | 2.86 | 1 | m | - | M31 | |
| 15<ax> | 2.92 | 1 | m | - | M30 | |
| 31<ax>, 24<ax> | 3.07 | 2 | m | - | M29 | |
| 17<ax>, 12<ax>, 29<ax> | 3.16 | 4 | m | - | M28 | |
| 33<ax> | 3.21 | 1 | m | - | M27 | |
| 39<ax>, 37<ax> | 3.32 | 2 | m | - | M26 | |
| 34<'> 13<'> | 3.41 | 2 | m | - | M25 | |
| 40<''> | 3.50 | 1 | m | - | M24 | |
| 40<'''> | 3.64 | 1 | dd | 10.51, 4.16 | M23 | |
| 34<''>, 13<''>, 21<ax> | 3.73 | 3 | d | 7.83 | M22 | |
| 8<ax> | 3.78 | 1 | s | - | M21 | |
| 25 | 4.12 | 1 | m | - | M41 | |
| 14 | 4.34 | 1 | t | 5.14 | M20 | |
| 23<ax> | 4.48 | 1 | d | 7.83 | M08 | |
| 41 | 4.56 | 1 | t | 5.62 | M19 | |
| 35 | 4.66 | 1 | t | 4.89 | M18 | |
| 20 | 4.69 | 1 | d | 2.45 | M17 | [4.67 .. 4.70] |
| 60<a> | 4.72 | 1 | s | - | M16 | [4.70 .. 4.73] |
| 60<b> | 4.79 | 1 | br. s. | - | M15 | [4.76 .. 4.80] |
| 10<ax> | 4.86 | 1 | d | 7.83 | M09 | [4.84 .. 4.88] |
| 38, 30 | 4.95 | 2 | br. s. | - | M14 | [4.93 .. 4.99] |
| 18 | 5.04 | 1 | d | 4.89 | M13 | [5.02 .. 5.06] |
| 32 | 5.11 | 1 | br. s. | - | M12 | [5.09 .. 5.13] |
| 16 | 5.16 | 1 | d | 6.36 | M11 | [5.14 .. 5.18] |
| 7<ax> | 5.49 | 2 | d | 8.31 | M10 | [5.46 .. 5.53] |

Kaurenol+3Glc (Isomer 1)

Kaurenol+3Glc (isomer 1)

| Atom1 | Shift1 (ppm) | H's | Type | J (Hz) | Multiplet1 | (ppm) |
|---|---|---|---|---|---|---|
| 46<'> | 0.74 | 1 | m | - | M32 | [0.70 .. 0.76] |
| 44<''>, 2a | 0.84 | 2 | m | - | M25 | [0.79 .. 0.89] |
| 61 | 0.93 | 3 | s | - | M08 | [0.91 .. 0.96] |
| 43 | 0.98 | 3 | s | - | M07 | [0.96 .. 1.00] |
| 48a, 57<'> | 1.04 | 2 | m | - | M28 | [1.01 .. 1.08] |
| 45 | 1.32 | 3 | s | - | M27 | [1.28 .. 1.34] |
| 59<'> | 1.36 | 1 | m | - | M36 | [1.34 .. 1.39] |
| 51<'>, 58<'> | 1.41 | 2 | m | - | M35 | [1.39 .. 1.44] |
| 58<''> | 1.46 | 1 | m | - | M26 | [1.44 .. 1.48] |
| 59<''>, 50, 51<''> | 1.56 | 4 | m | - | M34 | [1.48 .. 1.65] |
| 44<''>, 46<''> | 1.78 | 2 | m | - | M09 | [1.74 .. 1.82] |
| 57<''>, 55<''> | 1.94 | 2 | m | - | M29 | [1.88 .. 2.00] |
| 55<''> | 2.06 | 1 | m | - | M06 | [2.02 .. 2.09] |
| 52a | 2.59 | 1 | m | - | M24 | [2.57 .. 2.62] |
| 19<ax> | 2.94 | 1 | m | - | M23 | [2.91 .. 2.97] |
| 37<ax> | 3.02 | 1 | m | - | M30 | [2.99 .. 3.04] |
| 31<ax>, 24<ax> | 3.07 | 2 | m | - | M11 | [3.04 .. 3.11] |
| 15<ax> | 3.13 | 1 | t | 9.05 | M31 | [3.11 .. 3.15] |
| 17<ax>, 29<ax>, 12<ax>, 33<ax>, 39<ax> | 3.19 | 5 | m | - | M33 | [3.15 .. 3.23] |
| 4<'> | 3.24 | 1 | m | - | M22 | [3.23 .. 3.28] |
| 8<ax>, 21<ax> | 3.46 | 2 | m | - | M21 | [3.44 .. 3.48] |
| 13<'>, 34<'>, 40<'> | 3.51 | 3 | dd | 11.74, 7.82 | M12 | [3.48 .. 3.56] |
| 13<''>, 34<''>, 40<''> | 3.67 | 3 | m | - | M04 | [3.60 .. 3.72] |
| 44<''> | 3.86 | 1 | m | - | M03 | [3.83 .. 3.89] |
| 14, 10<ax> | 4.25 | 2 | d | 7.34 | M14 | [4.21 .. 4.30] |
| 23<ax> | 4.42 | 1 | d | 7.83 | M15 | [4.39 .. 4.45] |
| 35 | 4.51 | 1 | br. s. | - | M16 | [4.49 .. 4.54] |
| 38 | 4.59 | 1 | s | - | M17 | [4.56 .. 4.61] |
| 20, 7<ax> | 4.63 | 2 | d | 8.31 | M18 | [4.62 .. 4.66] |
| 60<a> | 4.71 | 1 | s | - | M01 | [4.69 .. 4.73] |
| 60<b> | 4.78 | 1 | br. s. | - | M19 | [4.75 .. 4.81] |
| 30, 41 | 4.92 | 2 | br. s. | - | M20 | [4.86 .. 4.96] |
| 18, 16, 32 | 5.07 | 3 | m | - | M02 | [5.01 .. 5.17] |
| 25 | 5.57 | 1 | m | - | | [5.52 .. 5.62] |

Figure 15I

Kaurenol+3Glc (isomer 1)

¹H NMR (800 MHz, DMSO $d_6$) δ ppm 0.70 - 0.76 (m, 1 H) 0.79 - 0.89 (m, 2 H) 0.93 (s, 3 H) 0.98 (s, 3 H) 1.01 - 1.08 (m, 2 H) 1.28 - 1.34 (m, 1 H) 1.34 - 1.39 (m, 1 H) 1.39 - 1.44 (m, 2 H) 1.44 - 1.48 (m, 1 H) 1.48 - 1.65 (m, 4 H) 1.74 - 1.82 (m, 2 H) 1.88 - 2.00 (m, 2 H) 2.02 - 2.09 (m, 1 H) 2.57 - 2.62 (m, 1 H) 2.91 - 2.97 (m, 1 H) 2.99 - 3.04 (m, 1 H) 3.04 - 3.11 (m, 2 H) 3.13 (t, J=9.05 Hz, 1 H) 3.15 - 3.23 (m, 5 H) 3.23 - 3.28 (m, 1 H) 3.44 - 3.48 (m, 2 H) 3.51 (dd, J=11.74, 7.82 Hz, 3 H) 3.67 (br. s., 3 H) 3.83 - 3.89 (m, 1 H) 4.25 (d, J=7.34 Hz, 2 H) 4.42 (d, J=7.83 Hz, 1 H) 4.51 (br. s., 1 H) 4.59 (s, 1 H) 4.63 (d, J=8.31 Hz, 2 H) 4.71 (s, 1 H) 4.78 (br. s., 2 H) 4.92 (br. s., 2 H) 5.01 - 5.17 (m, 3 H) 5.52 - 5.62 (m, 1 H)

¹³C NMR (201.21 MHz, DMSO $d_6$) δ ppm 155.8 (1C), 103.6 (1C), 103.4 (1C), 102.3 (1C), 102.1 (1C), 86.7 (1C), 78.6 (1C), 77.1 (1C), 77.0 (1C), 76.5 (1C), 76.4 (1C), 76.2 (1C), 74.7 (1C), 73.8 (1C), 72.2 (1C), 70.5 (1C), 70.2 (1C), 68.8 (1C), 61.5 (1C), 61.3 (1C), 61.1 (1C), 56.7 (1C), 55.9 (1C), 48.9 (1C), 44.1 (1C), 43.6 (1C), 41.4 (1C), 40.4 (1C), 39.1 (1C), 37.7 (1C), 36.4 (1C), 33.1 (1C), 28.0 (1C), 20.4 (1C), 18.4 (1C), 18.2 (1C), 18.1 (1C)

Steviol+6Glc (isomer 1)

Figure 15K

Steviol+6Glc (isomer 1)

| No. | Atom1 | Shift1 (ppm) | H's | Type | J (Hz) | Multiplet1 | (ppm) |
|---|---|---|---|---|---|---|---|
| 1 | 89, 6<'> | 0.74 | 4 | br s | - | M32 | [0.69...0.78] |
| 2 | 7a | 0.88 | 1 | m | - | M31 | [0.81...0.91] |
| 3 | 2<'> | 0.94 | 1 | m | - | M30 | [0.91...0.98] |
| 4 | 4 | 1.00 | 1 | br d | 12.72 | M29 | [0.98...1.04] |
| 5 | 90 | 1.11 | 3 | s | - | M28 | [1.07...1.15] |
| 6 | 11<'>, 14<'>, 1<'>, 9<'> | 1.34 | 4 | m | - | M26 | [1.27...1.38] |
| 7 | 13<'>, 9<'> | 1.42 | 2 | m | - | M27 | [1.38...1.49] |
| 8 | 13<'>, 10<'> | 1.64 | 2 | m | - | M25 | [1.58...1.67] |
| 9 | 6<'>, 1<'>, 10<'> | 1.72 | 3 | br d | 12.23 | M24 | [1.67...1.76] |
| 10 | 14<'> | 1.82 | 1 | br s | - | M23 | [1.79...1.86] |
| 11 | 16<'> | 1.96 | 1 | m | - | M22 | [1.89...1.98] |
| 12 | 16<'>, 11<'> | 2.00 | 2 | m | - | M21 | [1.98...2.04] |
| 13 | 2<'> | 2.10 | 1 | br d | 11.49 | M20 | [2.07...2.14] |
| 14 | 31<ax> | 2.92 | 1 | m | - | M15 | [2.90...2.95] |
| 15 | 85<ax>, 87<ax>, 35<ax>, 53<ax> | 3.05 | 4 | m | - | M14 | [3.00...3.09] |
| 16 | 80<ax>, 83<ax>, 43<ax>, 55<ax>, 56<ax>, 28<ax>, 47<ax>, 33<ax> | 3.16 | 8 | m | - | M13 | [3.10...3.21] |
| 17 | 45<ax>, 54<ax>, 74<ax>, 72<ax> | 3.25 | 4 | br dd | 17.24, 8.93 | M19 | [3.21...3.28] |
| 18 | 40<ax> | 3.31 | 1 | m | - | M11 | [3.30...3.32] |
| 19 | 69<ax>, 21<ax>, 22<ax> | 3.34 | 3 | br d | 4.65 | M18 | [3.32...3.35] |
| 20 | 29<'> | 3.38 | 1 | m | - | M12 | [3.36...3.43] |
| 21 | 81<'>, 41<'>, 58<'>, 70<'>, 24<ax> | 3.48 | 5 | m | - | M10 | [3.44...3.54] |
| 22 | 50<'> | 3.62 | 1 | br s | - | M16 | [3.59...3.64] |
| 23 | 81<'>, 41<'>, 58<'>, 76<ax>, 70<'>, 29<'> | 3.68 | 6 | m | - | M09 | [3.64...3.74] |
| 24 | 23<ax> | 3.75 | 1 | br d | 8.56 | M17 | [3.74...3.78] |
| 25 | 50<'> | 3.90 | 1 | br d | 11.25 | M06 | [3.86...3.94] |
| 26 | 52<ax> | 4.24 | 1 | d | 7.82 | M05 | [4.22...4.26] |
| 27 | 19<'>, 38 | 4.57 | 2 | br d | 7.83 | M07 | [4.56...4.59] |
| 28 | 78<ax> | 4.60 | 1 | br d | 7.58 | M08 | [4.59...4.63] |
| 29 | 26<ax> | 4.70 | 1 | br d | 7.82 | M04 | [4.67...4.72] |
| 30 | 17<a> | 4.76 | 1 | br s | - | M03 | [4.73...4.79] |
| 31 | 17<b> | 5.02 | 1 | br s | - | M02 | [5.00...5.05] |
| 32 | 67<ax> | 5.39 | 1 | br d | 7.34 | M01 | [5.37...5.42] |

¹H NMR (800 MHz, *DMSO-d₆*) δ ppm 0.74 (br s, 4 H) 0.81 - 0.91 (m, 1 H) 0.91 - 0.98 (m, 1 H) 1.00 (br d, *J*=12.72 Hz, 1 H) 1.11 (s, 3 H) 1.27 - 1.38 (m, 4 H) 1.38 - 1.49 (m, 2 H) 1.58 - 1.67 (m, 2 H) 1.67 (br d, *J*=12.23 Hz, 3 H) 1.72 (br d, *J*=12.23 Hz, 3 H) 1.82 (br s, 1 H) 1.89 - 1.98 (m, 1 H) 1.98 - 2.04 (m, 2 H) 2.10 (br d, *J*=11.49 Hz, 1 H) 2.90 - 2.95 (m, 1 H) 3.00 - 3.09 (m, 4 H) 3.10 - 3.21 (m, 8 H) 3.25 (br dd, *J*=17.24, 8.93 Hz, 4 H) 3.30 - 3.32 (m, 1 H) 3.34 (br d, *J*=4.65 Hz, 3 H) 3.36 - 3.43 (m, 1 H) 3.44 - 3.54 (m, 5 H) 3.62 (br s, 1 H) 3.64 - 3.74 (m, 6 H) 3.75 (br d, *J*=8.56 Hz, 1 H) 3.90 (br d, *J*=11.25 Hz, 1 H) 4.24 (d, *J*=7.82 Hz, 1 H) 4.57 (br d, *J*=7.83 Hz, 2 H) 4.60 (br d, *J*=7.58 Hz, 1 H) 4.70 (br d, *J*=7.82 Hz, 1 H) 4.76 (br s, 1 H) 5.02 (br s, 1 H) 5.39 (br d, *J*=7.34 Hz, 1 H)

$^{13}$C NMR (201 MHz, DMSO-$d_6$) δ ppm 17.1, 19.9, 20.6, 22.7, 29.2, 37.7, 38.3, 40.3, 40.8, 42.1, 42.2, 44.4, 44.8, 47.4, 54.0, 57.4, 61.6, 61.9, 62.0, 62.1, 62.7, 69.1, 69.3, 70.3, 70.8, 70.8, 71.3, 71.5, 74.2, 74.4, 75.1, 75.4, 75.6, 76.9, 77.2, 77.2, 77.2, 77.2, 77.2, 77.6, 77.8, 78.4, 79.6, 86.5, 88.4, 93.6, 96.4, 103.0, 103.3, 103.9, 105.8, 153.2, 178.0

Steviol+7Glc (isomer 2)

Steviol+7Glc (isomer 5)

Steviol+7Glc (isomer 5)

[Figure content: NMR data table and spectral assignments for Steviol+7Glc isomer 5, including ¹H NMR (600 MHz, DEUTERIUM OXIDE) and ¹³C NMR (201 MHz, DEUTERIUM OXIDE) spectral data, along with a chemical structure diagram.]

Figure 15W

Steviol+4Glc (#26)

| Multiplet | Shift (ppm) | Atom1 | H's | Type | J (Hz) | (ppm) |
|---|---|---|---|---|---|---|
| M35 | 5.50 | 2<ax> | 1 | m | - | [5.47 .. 5.53] |
| M46 | 5.49 | 52 | 1 | m | - | [5.47 .. 5.50] |
| M34 | 5.19 | 47 | 1 | d | 6.60 | [5.16 .. 5.21] |
| M33 | 5.15 | 62<b> | 1 | br s | - | [5.13 .. 5.16] |
| M32 | 5.10 | 51 | 1 | br d | 4.89 | [5.08 .. 5.13] |
| M31 | 5.03 | 50 | 1 | d | 5.38 | [5.00 .. 5.06] |
| M30 | 4.93 | 45, 46 | 2 | dd | 8.80, 4.89 | [4.90 .. 4.97] |
| M58 | 4.83 | 65, 67 | 2 | m | - | [4.81 .. 4.84] |
| M29 | 4.78 | 66, 11<ax>, 62<a> | 3 | m | - | [4.75 .. 4.81] |
| M59 | 4.66 | 24 | 1 | m | - | [4.65 .. 4.67] |
| M62 | 4.63 | 44 | 1 | m | - | [4.61 .. 4.64] |
| M27 | 4.56 | 26 | 1 | t | 5.50 | [4.54 .. 4.58] |
| M26 | 4.47 | 18<ax> | 1 | d | 7.83 | [4.44 .. 4.50] |
| M61 | 4.34 | 64 | 1 | m | - | [4.33 .. 4.36] |
| M60 | 4.31 | 49 | 1 | m | - | [4.30 .. 4.33] |
| M25 | 4.28 | 56<ax> | 1 | d | 7.82 | [4.26 .. 4.30] |
| M38 | 3.73 | 63<'> | 1 | m | - | [3.71 .. 3.74] |
| M36 | 3.71 | 48<'> | 1 | m | - | [3.69 .. 3.73] |
| M21 | 3.71 | 4<ax> | 1 | m | - | [3.69 .. 3.72] |
| M24 | 3.70 | 25<'>, 3<ax> | 2 | br dd | 9.90, 5.50 | [3.63 .. 3.75] |
| M23 | 3.59 | 43<'> | 1 | m | - | [3.56 .. 3.62] |
| M22 | 3.50 | 25<'> | 1 | m | - | [3.49 .. 3.52] |
| M47 | 3.40 | 43<'> | 1 | m | - | [3.38 .. 3.42] |
| M37 | 3.40 | 48<''> | 1 | m | - | [3.38 .. 3.42] |
| M39 | 3.39 | 63<'> | 1 | m | - | [3.37 .. 3.41] |
| M28 | 3.33 | 6<ax>, 5<ax> | 2 | m | - | [3.33 .. 3.34] |
| M20 | 3.21 | 20<ax> | 1 | m | - | [3.18 .. 3.23] |
| M19 | 3.14 | 60<ax>, 15<ax>, 22<ax> | 3 | m | - | [3.11 .. 3.17] |
| M48 | 3.14 | 13<ax> | 1 | m | - | [3.12 .. 3.16] |
| M40 | 3.07 | 21<ax> | 1 | m | - | [3.06 .. 3.09] |
| M18 | 3.05 | 23<ax> | 1 | m | - | [3.01 .. 3.09] |
| M41 | 3.03 | 59<ax> | 1 | m | - | [3.01 .. 3.05] |
| M17 | 2.98 | 58<ax> | 1 | m | - | [2.96 .. 3.00] |
| M16 | 2.90 | 61<ax> | 1 | m | - | [2.87 .. 2.93] |
| M42 | 2.90 | 14<ax> | 1 | m | - | [2.88 .. 2.91] |
| M15 | 2.83 | 16<ax> | 1 | q | 7.99 | [2.81 .. 2.85] |
| M14 | 2.40 | 36<''> | 1 | br d | 12.47 | [2.38 .. 2.43] |
| M13 | 2.06 | 41<''> | 1 | m | - | [2.03 .. 2.09] |
| M12 | 1.99 | 32<''>, 41<'> | 2 | br d | 13.45 | [1.96 .. 2.03] |
| M11 | 1.82 | 34<''> | 1 | m | - | [1.80 .. 1.85] |
| M45 | 1.78 | 39 | 2 | m | - | [1.75 .. 1.80] |
| M10 | 1.75 | 38<''> | 1 | m | - | [1.68 .. 1.79] |
| M43 | 1.74 | 37<''> | 1 | m | - | [1.72 .. 1.75] |
| M44 | 1.71 | 35<''> | 1 | m | - | [1.68 .. 1.73] |
| M09 | 1.49 | 35<'>, 40<''>, 32<'> | 3 | m | - | [1.43 .. 1.54] |
| M08 | 1.39 | 34<'> | 1 | br s | - | [1.37 .. 1.42] |
| M07 | 1.35 | 37<'>, 40<'> | 2 | br d | 4.40 | [1.31 .. 1.37] |
| M06 | 1.17 | 53 | 3 | s | - | [1.14 .. 1.19] |
| M05 | 1.01 | 28 | 1 | m | - | [0.98 .. 1.04] |
| M04 | 0.94 | 68 | 1 | br d | 8.07 | [0.92 .. 0.96] |
| M03 | 0.89 | 36<'> | 1 | m | - | [0.83 .. 0.91] |
| M02 | 0.82 | 54 | 3 | s | - | [0.80 .. 0.83] |
| M01 | 0.77 | 38<'> | 1 | m | - | [0.73 .. 0.80] |

¹H NMR (800 MHz, DMSO d₆) δ ppm 0.73 • 0.80 (m, 1 H) 0.82 (s, 3 H) 0.83 • 0.91 (m, 1 H) 0.94 (br d, J=8.07 Hz, 1 H) 0.98 • 1.04 (m, 1 H) 1.17 (s, 3 H) 1.35 (br d, J=4.40 Hz, 2 H) 1.39 (br s, 1 H) 1.43 • 1.54 (m, 3 H) 1.68 • 1.79 (m, 1 H) 1.68 • 1.73 (m, 1 H) 1.72 • 1.75 (m, 1 H) 1.75 • 1.80 (m, 2 H) 1.80 • 1.85 (m, 1 H) 1.99 (br d, J=13.45 Hz, 2 H) 2.03 • 2.09 (m, 1 H) 2.40 (br d, J=12.47 Hz, 1 H) 2.83 (q, J=7.99 Hz, 1 H) 2.87 • 2.93 (m, 1 H) 2.88 • 2.91 (m, 1 H) 2.96 • 3.00 (m, 1 H) 3.01 • 3.09 (m, 1 H) 3.01 • 3.05 (m, 1 H) 3.06 • 3.09 (m, 1 H) 3.11 • 3.17 (m, 3 H) 3.12 • 3.16 (m, 1 H) 3.18 • 3.23 (m, 1 H) 3.33 • 3.34 (m, 2 H) 3.37 • 3.41 (m, 1 H) 3.38 • 3.42 (m, 1 H) 3.38 • 3.42 (m, 1 H) 3.49 • 3.52 (m, 1 H) 3.59 (br dd, J=9.90, 5.50 Hz, 1 H) 3.63 • 3.75 (m, 2 H) 3.69 • 3.72 (m, 1 H) 3.69 • 3.73 (m, 1 H) 3.71 • 3.74 (m, 1 H) 4.28 (d, J=7.82 Hz, 1 H) 4.30 • 4.33 (m, 1 H) 4.33 • 4.36 (m, 1 H) 4.47 (d, J=7.83 Hz, 1 H) 4.56 (t, J=5.50 Hz, 1 H) 4.61 • 4.64 (m, 1 H) 4.65 • 4.67 (m, 1 H) 4.75 • 4.81 (m, 3 H) 4.81 • 4.84 (m, 2 H) 4.93 (dd, J=8.80, 4.89 Hz, 2 H) 5.03 (d, J=5.38 Hz, 1 H) 5.10 (br d, J=4.89 Hz, 1 H) 5.15 (br s, 1 H) 5.19 (d, J=6.60 Hz, 1 H) 5.47 • 5.50 (m, 1 H) 5.47 • 5.53 (m, 1 H)

Steviol+4Glc (#26)

| F2 Atom | δ(1H) (ppm) | F1 Atom | δ(13C) (ppm) | | | |
|---|---|---|---|---|---|---|
| 2<ax> | 5.52 | 2 | 91.9 | 35<'> | 1.5 | |
| 3<ax> | 3.73 | 3 | 75.5 | 36<'> | 2.4 | 36 | 36.6 |
| 4<ax> | 3.69 | 4 | 87 | 36<'> | 0.89 | | |
| 5<ax> | 3.34 | 5 | 68.3 | 37<'> | 1.74 | 37 | 19.5 |
| 6<ax> | 3.33 | 6 | 77.8 | 37<'> | 1.35 | | |
| | | 8 | 174.9 | 38<'> | 1.78 | 38 | 40.2 |
| 11<ax> | 4.79 | 11 | 101.8 | 38<'> | 0.77 | | |
| 13<ax> | 3.14 | 13 | 77.3 | 39 | 1.78 | 39 | 21.4 |
| 14<ax> | 2.89 | 14 | 71.4 | 40<'> | 1.49 | 40 | 41.3 |
| 15<ax> | 3.14 | 15 | 77 | 40<'> | 1.35 | | |
| 16<ax> | 2.83 | 16 | 74.3 | 41<'> | 2.06 | 41 | 47.8 |
| 18<ax> | 4.47 | 18 | 103.3 | 41<'> | 2 | | |
| 20<ax> | 3.21 | 20 | 77.3 | 43<'> | 3.59 | 42 | 152.6 |
| 21<ax> | 3.07 | 21 | 70.3 | 43<'> | 3.39 | 43 | 61.4 |
| 22<ax> | 3.14 | 22 | 77 | 48<'> | 3.4 | 48 | 61.3 |
| 23<ax> | 3.06 | 23 | 74 | 48<'> | 3.71 | | |
| 25<'> | 3.65 | 25 | 60.7 | 53 | 1.17 | 53 | 28.5 |
| 25<'> | 3.5 | | | 54 | 0.82 | 54 | 16.4 |
| | | | | 56<ax> | 4.28 | 56 | 98.1 |
| 28 | 1.01 | 27 | 43.6 | 58<ax> | 2.98 | 58 | 76.9 |
| | | 28 | 56.7 | 59<ax> | 3.03 | 59 | 70.5 |
| | | 29 | 39.1 | 60<ax> | 3.14 | 60 | 77 |
| | | 31 | 41.6 | 61<ax> | 2.91 | 61 | 74 |
| 32<'> | 2 | 32 | 43.6 | 62<a> | 4.77 | 62 | 104.8 |
| 32<'> | 1.48 | | | 62<b> | 5.15 | | |
| | | 33 | 85.8 | 63<'> | 3.73 | 63 | 62 |
| 34<'> | 1.82 | 34 | 37.9 | 63<'> | 3.39 | | |
| 34<'> | 1.39 | | | 68 | 0.94 | 30 | 53.4 |
| 35<'> | 1.7 | 35 | 20.1 | | | | |

13C NMR (201 MHz, DMSO d6) δ ppm 174.9 (1C), 152.6 (1C), 104.8 (1C), 103.3 (1C), 101.8 (1C), 98.1 (1C), 91.9 (1C), 87.0 (1C), 85.8 (1C), 77.8 (1C), 77.3 (2C), 77.0 (3C), 76.9 (1C), 75.5 (1C), 74.3 (1C), 74.0 (2C), 71.4 (1C), 70.5 (1C), 70.3 (1C), 68.3 (1C), 62.0 (1C), 61.4 (1C), 61.3 (1C), 60.7 (1C), 56.7 (1C), 53.4 (1C), 47.8 (1C), 43.6 (2C), 41.6 (1C), 41.3 (1C), 40.2 (1C), 39.1 (1C), 37.9 (1C), 36.6 (1C), 28.5 (1C), 21.4 (1C), 20.1 (1C), 19.5 (1C), 16.4 (1C)

PRODUCTION OF STEVIOL GLYCOSIDES IN RECOMBINANT HOSTS

This application is a U.S. National Phase application under 35 U.S.C. § 371 of PCT/EP2017/061775, filed May 16, 2017, which claims priority from and the benefit of U.S. Provisional Application No. 62/337,190, filed on May 16, 2016, the specifications of which are hereby incorporated by reference in their entireties the specifications of which is hereby incorporated by reference in its entirety.

BACKGROUND OF THE INVENTION

Field of the Invention

This disclosure relates to recombinant production of steviol glycosides, glycosides of steviol precursors, and steviol glycoside precursors in recombinant hosts. In particular, this disclosure relates to production of steviol glycosides comprising steviol-13-O-glucoside (13-SMG), steviol-19-O-glucoside (19-SMG), steviol-1,2-bioside, steviol-1,3-bioside, 1,2-stevioside, 1,3-stevioside, rubusoside, Rebaudioside A (RebA), Rebaudioside B (RebB), Rebaudioside C (RebC), Rebaudioside D (RebD), Rebaudioside E (RebE), Rebaudioside F (RebF), Rebaudioside M (RebM), Rebaudioside Q (RebQ), Rebaudioside I (RebI), dulcoside A, mono-glycosylated ent-kaurenoic acids, di-glycosylated ent-kaurenoic acids, tri-glycosylated ent-kaurenoic acids, mono-glycosylated ent-kaurenols, di-glycosylated ent-kaurenols, tri-glycosylated ent-kaurenols, tri-glycosylated steviol glycosides, tetra-glycosylated steviol glycosides, penta-glycosylated steviol glycosides, hexa-glycosylated steviol glycosides, hepta-glycosylated steviol glycosides, or isomers thereof in recombinant hosts.

Description of Related Art

Sweeteners are well known as ingredients used most commonly in the food, beverage, or confectionary industries. The sweetener can either be incorporated into a final food product during production or for stand-alone use, when appropriately diluted, as a tabletop sweetener or an at-home replacement for sugars in baking. Sweeteners include natural sweeteners such as sucrose, high fructose corn syrup, molasses, maple syrup, and honey and artificial sweeteners such as aspartame, saccharine, and sucralose. *Stevia* extract is a natural sweetener that can be isolated and extracted from a perennial shrub, *Stevia rebaudiana*. *Stevia* is commonly grown in South America and Asia for commercial production of *stevia* extract. *Stevia* extract, purified to various degrees, is used commercially as a high intensity sweetener in foods and in blends or alone as a tabletop sweetener.

Chemical structures for several steviol glycosides are shown in FIG. 1, including the diterpene steviol and various steviol glycosides. Extracts of the *Stevia* plant generally comprise steviol glycosides that contribute to the sweet flavor, although the amount of each steviol glycoside often varies, inter alia, among different production batches.

As recovery and purification of steviol glycosides from the *Stevia* plant have proven to be labor intensive and inefficient, there remains a need for a recombinant production system that can accumulate high yields of desired steviol glycosides, such as RebD and RebM. There also remains a need for improved production of steviol glycosides in recombinant hosts for commercial uses. As well, there remains a need for identifying enzymes selective towards particular substrates to produce one or more specific steviol glycosides. In some aspects, there remains a need to increase the catalytic capability of enzymes with 19-O glycosylation activity in order to produce higher yields of steviol glycosides.

SUMMARY OF THE INVENTION

It is against the above background that the present invention provides certain advantages and advancements over the prior art.

Although this invention as disclosed herein is not limited to specific advantages or functionalities, the invention provides a recombinant host cell capable of producing one or more steviol glycosides and/or glycosylated steviol precursors, or a composition thereof, comprising:

(a) a gene encoding a polypeptide capable of glycosylating steviol or a steviol glycoside at its C-19 carboxyl group, having at least 55% sequence identity to the amino acid sequence set forth in SEQ ID NO:4, and further having at least one amino acid substitution corresponding to residues 79, 80, 81, 83, 184, 260, 286, or 377 of SEQ ID NO:4;

(b) a gene encoding a polypeptide capable of glycosylating steviol or a steviol glycoside at its C-19 carboxyl group, having at least 55% sequence identity to the amino acid sequence set forth in SEQ ID NO:4, and further having at least one amino acid substitution corresponding to residues 68, 69, 70, 71, 72, 73, 74, 75, 76, 77, 78, 79, 80, 81, 82, or 83 of SEQ ID NO:4;

(c) a gene encoding a bifunctional polypeptide capable of glycosylating steviol or a steviol glycoside at its C-19 carboxyl group and glycosylating steviol or a steviol glycoside at its C-13 hydroxyl group, having at least 50% sequence identity to the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148; and/or (d) a gene encoding a tagged polypeptide capable of glycosylating steviol or a steviol glycoside at its C-19 carboxyl group, having at least 55% sequence identity to the amino acid sequence set forth in SEQ ID NO:174, SEQ ID NO:176, SEQ ID NO:178, or SEQ ID NO:180;

wherein at least one of the genes is a recombinant gene; and wherein the recombinant host cell is capable of producing a glycoside of ent-kaurenoic acid, ent-kaurenol, or steviol.

In one aspect of the recombinant host cell disclosed herein, the polypeptide capable of glycosylating steviol or a steviol glycoside at its C-19 carboxyl group comprises a M79V, M79E, S80C, A81W, E83K, H184V, H184T N260T, K286C, K286E, K286N, K286T, and/or S377Q amino acid substitution corresponding to SEQ ID NO:4.

In one aspect of the recombinant host cell disclosed herein, the polypeptide capable of glycosylating steviol or a steviol glycoside at its C-19 carboxyl group comprises:

(a) a K286C substitution corresponding to SEQ ID NO:4;
(b) a M79V substitution corresponding to SEQ ID NO:4;
(c) a S377Q substitution corresponding to SEQ ID NO:4;
(d) a S80C substitution corresponding to SEQ ID NO:4;
(e) a N260T and a K286C substitution corresponding to SEQ ID NO:4;
(f) a H184V substitution corresponding to SEQ ID NO:4;
(g) a A81W and a E83K substitution corresponding to SEQ ID NO:4;
(h) a A81W substitution corresponding to SEQ ID NO:4;

(i) a H184T substitution corresponding to SEQ ID NO:4;
(k) a K286N substitution corresponding to SEQ ID NO:4;
(l) a M79E substitution corresponding to SEQ ID NO:4; or
(m) a K286T substitution corresponding to SEQ ID NO:4.

In one aspect of the recombinant host cell disclosed herein, the polypeptide capable of glycosylating steviol or a steviol glycoside at its C-19 carboxyl group further comprises a tag.

In one aspect of the recombinant host cell disclosed herein, the tag comprises a tag sequence having at least 90% identity to disulfide oxidoreductase of SEQ ID NO:152, maltose binding protein of SEQ ID NO:153, N-utilization substance of SEQ ID NO:154, or small ubiquitin-like modifier of SEQ ID NO:155.

In one aspect of the recombinant host cell disclosed herein, the polypeptide capable of glycosylating steviol or a steviol glycoside at its C-19 carboxyl group comprises a polypeptide having at least 55% sequence identity to the amino acid sequence set forth in SEQ ID NO:174, SEQ ID NO:176, SEQ ID NO:178, or SEQ ID NO:180.

In one aspect of the recombinant host cell disclosed herein, the recombinant host cell further comprises:
(a) a gene encoding a polypeptide capable of synthesizing geranylgeranyl pyrophosphate (GGPP) from farnesyl diphosphate (FPP) and isopentenyl diphosphate (IPP);
(b) a gene encoding a polypeptide capable of synthesizing ent-copalyl diphosphate from GGPP;
(c) a gene encoding an a polypeptide capable of synthesizing ent-kaurene from ent-copalyl diphosphate;
(d) a gene encoding a polypeptide capable of synthesizing ent-kaurenoic acid from ent-kaurene;
(e) a gene encoding a polypeptide capable of reducing cytochrome P450 complex;
(f) a gene encoding a polypeptide capable of synthesizing steviol from ent-kaurenoic acid;
(g) a gene encoding a polypeptide capable of glycosylating steviol or a steviol glycoside at its C-13 hydroxyl group thereof;
(h) a gene encoding a polypeptide capable of beta 1,3 glycosylation of the C3' of the 13-O-glucose, 19-O-glucose, or both 13-O-glucose and 19-O-glucose of a steviol glycoside;
(i) a gene encoding a polypeptide capable of glycosylating steviol or a steviol glycoside at its C-19 carboxyl group thereof; and/or
(k) a gene encoding a polypeptide capable of beta 1,2 glycosylation of the C2' of the 13-O-glucose, 19-O-glucose, or both 13-O-glucose and 19-O-glucose of a steviol glycoside;
wherein at least one of the genes is a recombinant gene.

In one aspect of the recombinant host cell disclosed herein:
(a) the polypeptide capable of synthesizing GGPP comprises a polypeptide having at least 70% sequence identity to the amino acid sequence set forth in SEQ ID NO:20, SEQ ID NO:22, SEQ ID NO:24, SEQ ID NO:26, SEQ ID NO:28, SEQ ID NO:30, SEQ ID NO:32, or SEQ ID NO:116;
(b) the polypeptide capable of synthesizing ent-copalyl diphosphate comprises a polypeptide having at least 70% sequence identity to the amino acid sequence set forth in SEQ ID NO:34, SEQ ID NO:36, SEQ ID NO:38, SEQ ID NO:40, SEQ ID NO:42, or SEQ ID NO:120;
(c) the polypeptide capable of synthesizing ent-kaurene comprises a polypeptide having at least 70% sequence identity to the amino acid sequence set forth in SEQ ID NO:44, SEQ ID NO:46, SEQ ID NO:48, SEQ ID NO:50, or SEQ ID NO:52;
(d) the polypeptide capable of synthesizing ent-kaurenoic acid comprises a polypeptide having at least 70% sequence identity to the amino acid sequence set forth in SEQ ID NO:60, SEQ ID NO:62, SEQ ID NO:117, SEQ ID NO:66, SEQ ID NO:68, SEQ ID NO:70, SEQ ID NO:72, SEQ ID NO:74, or SEQ ID NO:76;
(e) the polypeptide capable of reducing cytochrome P450 complex comprises a polypeptide having at least 70% sequence identity to the amino acid sequence set forth in SEQ ID NO:78, SEQ ID NO:80, SEQ ID NO:82, SEQ ID NO:84, SEQ ID NO:86, SEQ ID NO:88, SEQ ID NO:90, SEQ ID NO:92;
(f) the polypeptide capable of synthesizing steviol comprises a polypeptide having at least 70% sequence identity to the amino acid sequence set forth in SEQ ID NO:94, SEQ ID NO:97, SEQ ID NO:100, SEQ ID NO:101, SEQ ID NO:102, SEQ ID NO:103, SEQ ID NO:104, SEQ ID NO:106, SEQ ID NO:108, SEQ ID NO:110, SEQ ID NO:112, or SEQ ID NO:114;
(g) the polypeptide capable of glycosylating steviol or a steviol glycoside at its C-13 hydroxyl group thereof comprises a polypeptide having at least 55% sequence identity to the amino acid sequence set forth in SEQ ID NO:7;
(h) the polypeptide capable of beta 1,3 glycosylation of the C3' of the 13-O-glucose, 19-O-glucose, or both 13-O-glucose and 19-O-glucose of a steviol glycoside comprises a polypeptide having at least 50% sequence identity to the amino acid sequence set forth in SEQ ID NO:9;
(i) the polypeptide capable of glycosylating steviol or a steviol glycoside at its C-19 carboxyl group thereof comprises a polypeptide having at least 55% sequence identity to the amino acid sequence set forth in SEQ ID NO:4; and/or
(k) the polypeptide capable of beta 1,2 glycosylation of the C2' of the 13-O-glucose, 19-O-glucose, or both 13-O-glucose and 19-O-glucose of a steviol glycoside comprises a polypeptide having 80% or greater identity to the amino acid sequence set forth in SEQ ID NO:11; a polypeptide having 80% or greater identity to the amino acid sequence set forth in SEQ ID NO:13; or a polypeptide having at least 65% sequence identity to the amino acid sequence set forth in SEQ ID NO:16.

In one aspect of the recombinant host cell disclosed herein, expression of the one or more recombinant increases an amount of the one or more steviol glycosides and/or glycosylated steviol precursors, or a composition thereof accumulated by the cell relative to a corresponding host lacking the one or more recombinant genes.

In one aspect of the recombinant host cell disclosed herein, expression of the one or more recombinant genes increases the amount of the one or more steviol glycosides and/or glycosylated steviol precursors, or the composition thereof, accumulated by the cell by at least about 5%, at least about 10%, at least about 25%, at least about 50%, at least about 75%, or at least about 100% relative to a corresponding host lacking the one or more recombinant genes.

In one aspect of the recombinant host cell disclosed herein, expression of the one or more recombinant genes increases the amount of ent-kaurenoic acid+3Glc (isomer 2), ent-kaurenol+2Glc (#8), ent-kaurenol+3Glc (isomer 1 and/or isomer 2), steviol-13-O-glucoside (13-SMG), steviol-19-O-glucoside (19-SMG), steviol-1,2-bioside, steviol-1,3-bioside, rubusoside, 1,2-stevioside, Rebaudioside A (RebA), Rebaudioside B (RebB), Rebaudioside E (RebE), steviol+4Glc (#24 and/or #25), steviol+4Glc (#26), steviol+4Glc (#33), Rebaudioside D (RebD), steviol+5Glc, Rebaudioside M (RebM), steviol+6Glc (#23), steviol+7Glc (isomer 2), and/or steviol+7Glc (isomer 5) accumulated by the cell relative to a corresponding host lacking the one or more recombinant genes.

In one aspect of the recombinant host cell disclosed herein, expression of the one or more recombinant genes decreases the amount of the one or more steviol glycosides and/or glycosylated steviol precursors, or the composition thereof accumulated by the cell relative to a corresponding host lacking the one or more recombinant genes.

In one aspect of the recombinant host cell disclosed herein, expression of the one or more recombinant genes decreases the amount of the one or more steviol glycosides accumulated by the cell by at least about 5%, at least about 10%, at least about 25%, or at least about 50% relative to a corresponding host lacking the one or more recombinant genes.

In one aspect of the recombinant host cell disclosed herein, expression of the one or more recombinant genes decreases the amount of ent-kaurenoic acid+2Glc (#7), ent-kaurenoic acid+3Glc (isomer 1), ent-kaurenoic acid+3Glc (isomer 2), 19-SMG, 1,2-stevioside, RebA, steviol+4Glc (#26), RebD, steviol+5Glc (#24), steviol+5Glc (#25), steviol+6Glc (isomer 1), RebM, steviol+7Glc (isomer 2), and/or steviol+7Glc (isomer 5) accumulated by the cell relative to a corresponding host lacking the one or more recombinant genes.

In one aspect of the recombinant host cell disclosed herein, the one or more steviol glycosides and/or glycosylated steviol precursors are, or the composition thereof comprises, 13-SMG, 19-SMG, steviol-1,2-bioside, steviol-1,3-bioside, 1,2-stevioside, 1,3-stevioside, rubusoside, RebA, RebB, RebC, RebD, RebE, Rebaudioside F (RebF), RebM, Rebaudioside Q (RebQ), Rebaudioside I (RebI), dulcoside A, a mono-glycosylated ent-kaurenoic acid, a di-glycosylated ent-kaurenoic acid, a tri-glycosylated ent-kaurenoic acid, a mono-glycosylated ent-kaurenols, a di-glycosylated ent-kaurenol, a tri-glycosylated ent-kaurenol, a tri-glycosylated steviol glycoside, a tetra-glycosylated steviol glycoside, a penta-glycosylated steviol glycoside, a hexa-glycosylated steviol glycoside, a hepta-glycosylated steviol glycoside, and/or an isomer thereof.

In one aspect of the recombinant host cell disclosed herein:
(a) the di-glycosylated ent-kaurenoic acid comprises KA2.7 of Table 1;
(b) the tri-glycosylated ent-kaurenoic acid comprises KA3.1 or KA3.2 of Table 1;
(c) the di-glycosylated ent-kaurenol comprises KL2.8 of Table 1;
(d) the tri-glycosylated ent-kaurenol comprises KL3.1 or KOL3.2 of Table 1;
(e) the steviol glycoside comprises 13-SMG, 19-SMG, steviol-1,2-bioside, steviol-1,3-bioside, rubusoside, RebA, RebE, RebD or RebM;
(f) the tetra-glycosylated steviol comprises Compound 4.26 or Compound 4.33 of Table 1;
(g) the penta-glycosylated steviol comprises Compound 5.24 or Compound 5.25 of Table 1;
(h) the hexa-glycosylated steviol comprises Compound 6.1 or Compound 6.23 of Table 1; and/or
(i) the hepta-glycosylated steviol comprises Compound 7.2 or Compound 7.5 of Table 1.

In one aspect of the recombinant host cell disclosed herein, the recombinant host cell comprises a plant cell, a mammalian cell, an insect cell, a fungal cell, an algal cell, or a bacterial cell.

The invention also provides a method of producing a one or more steviol glycosides and/or glycosylated steviol precursors, or a composition thereof in a cell culture, comprising growing the recombinant host cell disclosed herein in the cell culture, under conditions in which the genes are expressed, and wherein the one or more steviol glycosides and/or glycosylated steviol precursors, or the composition thereof is produced by the recombinant host cell in the cell culture.

In one aspect of the method disclosed herein, the genes are constitutively expressed and/or expression of the genes is induced.

In one aspect of the method disclosed herein, the amount of ent-kaurenoic acid+3Glc (isomer 2), ent-kaurenol+2Glc (#8), ent-kaurenol+3Glc (isomer 1 and/or isomer 2), 13-SMG, 19-SMG, steviol-1,2-bioside, steviol-1,3-bioside, rubusoside, 1,2-stevioside, RebB, RebA, RebE, steviol+4Glc (#24 and/or #25), steviol+4Glc (#26), steviol+4Glc (#33), RebD, steviol+5Glc, RebM, steviol+6Glc (#23), steviol+7Glc (isomer 2), and/or steviol+7Glc (isomer 5) accumulated by the cell is increased by at least about 5% relative to a corresponding host lacking the one or more recombinant genes.

In one aspect of the method disclosed herein, the amount of ent-kaurenoic acid+2Glc (#7), ent-kaurenoic acid+3Glc (isomer 1), ent-kaurenoic acid+3Glc (isomer 2), 19-SMG, 1,2-stevioside, RebA, steviol+4Glc (#26), RebD, steviol+5Glc (#24), steviol+5Glc (#25), steviol+6Glc (isomer 1), RebM, steviol+7Glc (isomer 2), and/or steviol+7Glc (isomer 5) accumulated by the cell is decreased by at least about 5% relative to a corresponding host lacking the one or more recombinant genes.

In one aspect, the method disclosed herein further comprises isolating from the cell cultures the one or more steviol glycosides and/or glycosylated steviol precursors or the composition thereof produced thereby.

In one aspect of the method disclosed herein, the isolating step comprises:
(a) providing the cell culture comprising the one or more steviol glycosides and/or glycosylated steviol precursors, or the composition thereof;
(b) separating a liquid phase of the cell culture from a solid phase of the cell culture to obtain a supernatant comprising the produced one or more steviol glycosides and/or glycosylated steviol precursors, or the composition thereof;
(c) providing one or more adsorbent resins, comprising providing the adsorbent resins in a packed column; and
(d) contacting the supernatant of step (b) with the one or more adsorbent resins in order to obtain at least a portion of the produced one or more steviol glycosides and/or glycosylated steviol precursors, or the composition thereof, thereby isolating the produced one or more steviol glycosides and/or glycosylated steviol precursors, or the composition thereof;
or
(a) providing the cell culture comprising the one or more steviol glycosides and/or glycosylated steviol precursors, or the composition thereof;
(b) separating a liquid phase of the cell culture from a solid phase of the cell culture to obtain a supernatant comprising the produced one or more steviol glycosides and/or glycosylated steviol precursors, or the composition thereof;

(c) providing one or more ion exchange or ion exchange or reversed-phase chromatography columns; and (d) contacting the supernatant of step (b) with the one or more ion exchange or ion exchange or reversed-phase chromatography columns in order to obtain at least a portion of the produced one or more steviol glycosides and/or glycosylated steviol precursors, or the composition thereof, thereby isolating the produced one or more steviol glycosides and/or glycosylated steviol precursors, or the composition thereof;

or (a) providing the cell culture comprising the one or more steviol glycosides and/or glycosylated steviol precursors, or the composition thereof;

(b) separating a liquid phase of the cell culture from a solid phase of the cell culture to obtain a supernatant comprising the produced one or more steviol glycosides and/or glycosylated steviol precursors, or the composition thereof;

(c) crystallizing or extracting the produced one or more steviol glycosides and/or glycosylated steviol precursors, or the composition thereof, thereby isolating the produced one or more steviol glycosides and/or glycosylated steviol precursors, or the composition thereof.

In one aspect, the method disclosed herein further comprises recovering the one or more steviol glycosides and/or glycosylated steviol precursors or the composition thereof from the cell culture, wherein the cell culture is enriched for the one or more steviol glycosides and/or glycosylated steviol precursors, or the composition thereof relative to a steviol glycoside composition from a *Stevia* plant and has a reduced level of *Stevia* plant-derived components relative to a plant-derived *Stevia* extract.

In one aspect of the method disclosed herein, the recovered one or more steviol glycosides and/or glycosylated steviol precursors or the composition thereof are present in relative amounts that are different from a steviol glycoside composition recovered from a *Stevia* plant and have a reduced level of *Stevia* plant-derived components relative to a plant-derived *Stevia* extract.

The invention also provides a method for producing one or more steviol glycosides and/or glycosylated steviol precursors, or a composition thereof, comprising whole cell bioconversion of plant-derived or synthetic steviol, steviol precursors, glycosylated steviol precursors and/or steviol glycosides in a cell culture medium of a recombinant host cell cell using:

(a) a polypeptide capable of glycosylating steviol or a steviol glycoside at its C-19 carboxyl group having at least 55% sequence identity to the amino acid sequence set forth in SEQ ID NO:4, and further having at least one amino acid substitution corresponding to residues 79, 80, 81, 83, 184, 260, 286, or 377 of SEQ ID NO:4;

(b) a polypeptide capable of glycosylating steviol or a steviol glycoside at its C-19 carboxyl group, having at least 55% sequence identity to the amino acid sequence set forth in SEQ ID NO:4, and further having at least one amino acid substitution corresponding to residues 68, 69, 70, 71, 72, 73, 74, 75, 76, 77, 78, 79, 80, 81, 82, or 83 of SEQ ID NO:4;

(c) a bifunctional polypeptide capable of glycosylating steviol or a steviol glycoside at its C-19 carboxyl group and glycosylating steviol or a steviol glycoside at its C-13 hydroxyl group, having at least 50% sequence identity to the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148; and/or (d) a tagged polypeptide capable of glycosylating steviol or a steviol glycoside at its C-19 carboxyl group, having at least 55% sequence identity to the amino acid sequence set forth in SEQ ID NO:174, SEQ ID NO:176, SEQ ID NO:178, or SEQ ID NO:180;

wherein at least one of the polypeptides is a recombinant polypeptide expressed in the recombinant host cell; and producing the one or more steviol glycosides and/or glycosylated steviol precursors, or the composition thereof, thereby.

In one aspect of the method disclosed herein, the recombinant host cell is a plant cell, a mammalian cell, an insect cell, a fungal cell, an algal cell or a bacterial cell.

The invention also provides an in vitro method for producing one or more steviol glycosides and/or glycosylated steviol precursors, or a composition thereof comprising adding:

(a) a polypeptide capable of glycosylating steviol or a steviol glycoside at its C-19 carboxyl group having at least 55% sequence identity to the amino acid sequence set forth in SEQ ID NO:4, and further having at least one amino acid substitution corresponding to residues 79, 80, 81, 83, 184, 260, 286, or 377 of SEQ ID NO:4;

(b) a polypeptide capable of glycosylating steviol or a steviol glycoside at its C-19 carboxyl group, having at least 55% sequence identity to the amino acid sequence set forth in SEQ ID NO:4, and further having at least one amino acid substitution corresponding to residues 68, 69, 70, 71, 72, 73, 74, 75, 76, 77, 78, 79, 80, 81, 82, or 83 of SEQ ID NO:4;

(c) a bifunctional polypeptide capable of glycosylating steviol or a steviol glycoside at its C-19 carboxyl group and glycosylating steviol or a steviol glycoside at its C-13 hydroxyl group, having at least 50% sequence identity to the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148; and/or (d) a tagged polypeptide capable of glycosylating steviol or a steviol glycoside at its C-19 carboxyl group, having at least 55% sequence identity to the amino acid sequence set forth in SEQ ID NO:174, SEQ ID NO:176, SEQ ID NO:178, or SEQ ID NO:180;

and a plant-derived or synthetic steviol glycoside precursor or a plant-derived or synthetic steviol precursor to a reaction mixture;

wherein at least one of the polypeptides is a recombinant polypeptide; and producing the one or more steviol glycosides and/or glycosylated steviol precursors, or the composition thereof, thereby.

In one aspect of the method disclosed herein, the reaction mixture comprises:

(a) glucose, fructose, sucrose, xylose, rhamnose, uridine diphosphate (UDP)-glucose, UDP-rhamnose, UDP-xylose, and/or N-acetyl-glucosamine; and/or (b) reaction buffer and/or salts.

In one aspect of the method disclosed herein, the one or more steviol glycosides and/or glycosylated steviol precursors are, or the composition thereof comprises 13-SMG, 19-SMG, steviol-1,2-bioside, steviol-1,3-bioside, 1,2-stevioside, 1,3-stevioside, rubusoside, RebA, RebB, RebC, RebD, RebE, RebF, RebM, RebQ, RebI, dulcoside A, a mono-glycosylated ent-kaurenoic acid, a di-glycosylated ent-kaurenoic acid, a tri-glycosylated ent-kaurenoic acid, a mono-glycosylated ent-kaurenols, a di-glycosylated ent-kaurenol, a tri-glycosylated ent-kaurenol, a tri-glycosylated steviol glycoside, a tetra-glycosylated steviol glycoside, a penta-glycosylated steviol glycoside, a hexa-glycosylated steviol glycoside, a hepta-glycosylated steviol glycoside, or an isomer thereof.

In one aspect of the method disclosed herein:
(a) the di-glycosylated ent-kaurenoic acid comprises KA2.7 of Table 1;
(b) the tri-glycosylated ent-kaurenoic acid comprises KA3.1 or KA3.2 of Table 1;
(c) the di-glycosylated ent-kaurenol comprises KL2.8 of Table 1;
(d) the tri-glycosylated ent-kaurenol comprises KL3.1 or KOL3.2 of Table 1;
(e) the steviol glycoside comprises 13-SMG, 19-SMG, steviol-1,2-bioside, steviol-1,3-bioside, rubusoside, RebA, RebE, RebD or RebM;
(f) the tetra-glycosylated steviol comprises Compound 4.26 or Compound 4.33 of Table 1;
(g) the penta-glycosylated steviol comprises Compound 5.24 or Compound 5.25 of Table 1;
(h) the hexa-glycosylated steviol comprises Compound 6.1 or Compound 6.23 of Table 1; and/or
(i) the hepta-glycosylated steviol comprises Compound 7.2 or Compound 7.5 of Table 1.

The invention also provides a cell culture, comprising the recombinant host cell of disclosed herein, the cell culture further comprising:
(a) the one or more steviol glycosides and/or glycosylated steviol precursors, or the composition thereof produced by the recombinant host cell,
(b) glucose, fructose, sucrose, xylose, rhamnose, UDP-glucose, UDP-rhamnose, UDP-xylose, and/or N-acetyl-glucosamine; and
(c) supplemental nutrients comprising trace metals, vitamins, salts, yeast nitrogen base (YNB), and/or amino acids;
wherein the one or more steviol glycosides and/or glycosylated steviol precursors, or the composition thereof is present at a concentration of at least 1 mg/liter of the cell culture;
wherein the cell culture is enriched for the one or more steviol glycosides and/or glycosylated steviol precursors, or the composition thereof relative to a steviol glycoside composition from a Stevia plant and has a reduced level of Stevia plant-derived components relative to a plant-derived Stevia extract.

The invention also provides a cell lysate from the recombinant host cell disclosed herein grown in the cell culture, comprising:
(a) the one or more steviol glycosides and/or glycosylated steviol precursors, or the composition thereof produced by the recombinant host cell;
(b) glucose, fructose, sucrose, xylose, rhamnose, UDP-glucose, UDP-rhamnose, UDP-xylose, and/or N-acetyl-glucosamine; and/or
(c) supplemental nutrients comprising trace metals, vitamins, salts, yeast nitrogen base, YNB, and/or amino acids;
wherein the one or more steviol glycosides and/or glycosylated steviol precursors, or the composition thereof produced by the recombinant host cell is present at a concentration of at least 1 mg/liter of the cell culture.

The invention also provides a reaction mixture, comprising:
(a) a polypeptide capable of glycosylating steviol or a steviol glycoside at its C-19 carboxyl group having at least 55% sequence identity to the amino acid sequence set forth in SEQ ID NO:4, and further having at least one amino acid substitution corresponding to residues 79, 80, 81, 83, 184, 260, 286, or 377 of SEQ ID NO:4;
(b) a polypeptide capable of glycosylating steviol or a steviol glycoside at its C-19 carboxyl group, having at least 55% sequence identity to the amino acid sequence set forth in SEQ ID NO:4, and further having at least one amino acid substitution corresponding to residues 68, 69, 70, 71, 72, 73, 74, 75, 76, 77, 78, 79, 80, 81, 82, or 83 of SEQ ID NO:4;
(c) a bifunctional polypeptide capable of glycosylating steviol or a steviol glycoside at its C-19 carboxyl group and glycosylating steviol or a steviol glycoside at its C-13 hydroxyl group, having at least 50% sequence identity to the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148; and/or
(d) a tagged polypeptide capable of glycosylating steviol or a steviol glycoside at its C-19 carboxyl group, having at least 55% sequence identity to the amino acid sequence set forth in SEQ ID NO:174, SEQ ID NO:176, SEQ ID NO:178, or SEQ ID NO:180;
and further comprising:
(e) one or more steviol glycosides and/or glycosylated steviol precursors, or a composition thereof;
(f) glucose, fructose, sucrose, xylose, rhamnose, uridine diphosphate (UDP)-glucose, UDP-rhamnose, UDP-xylose, and/or N-acetyl-glucosamine; and/or
(g) reaction buffer and/or salts.

The invention also provides a composition of one or more steviol glycosides and/or glycosylated steviol precursors produced by the recombinant host cell disclosed herein; wherein the one or more steviol glycosides and/or glycosylated steviol precursors produced by the recombinant host cell are present in relative amounts that are different from a steviol glycoside composition from a Stevia plant and have a reduced level of Stevia plant-derived components relative to a plant-derived Stevia extract.

The invention also provides a composition of one or more steviol glycosides and/or glycosylated steviol precursors produced by the method disclosed herein; wherein the one or more steviol glycosides and/or glycosylated steviol precursors produced by the recombinant host cell are present in relative amounts that are different from a steviol glycoside composition from a Stevia plant and have a reduced level of Stevia plant-derived components relative to a plant-derived Stevia extract.

The invention also provides a sweetener composition, comprising one or more steviol glycosides and/or glycosylated steviol precursors produced by the recombinant host cell and/or the method disclosed herein.

The invention also provides a food product, comprising the sweetener composition disclosed herein.

The invention also provides a beverage or a beverage concentrate, comprising the sweetener composition disclosed herein.

The invention also provides a nucleic acid molecule encoding a polypeptide or a catalytically active portion thereof capable of glycosylating steviol or a steviol glycoside at its C-19 carboxyl group, wherein the encoded polypeptide or the catalytically active portion thereof comprises a polypeptide having at least 55% sequence identity to the amino acid sequence set forth in SEQ ID NO:4, and further comprises a polypeptide having at least one amino acid substitution corresponding to residues 79, 80, 81, 83, 184, 260, 286, or 377 of SEQ ID NO:4.

The invention also provides a nucleic acid molecule encoding a polypeptide or a catalytically active portion thereof capable of glycosylating steviol or a steviol glycoside at its C-19 carboxyl group, wherein the encoded polypeptide or the catalytically active portion thereof comprises a polypeptide having at least 55% sequence identity to the amino acid sequence set forth in SEQ ID NO:4, and further comprises a polypeptide having at least one amino acid substitution corresponding to residues 68, 69, 70, 71, 72, 73, 74, 75, 76, 77, 78, 79, 80, 81, 82, or 83 of SEQ ID NO:4.

In one aspect of the nucleic acid molecule disclosed herein, the encoded polypeptide or the catalytically active portion thereof comprises a M79V, M79E, S80C, A81W, E83K, H184V, H184T N260T, K286C, K286E, K286N, K286T, and/or S377Q amino acid substitution corresponding to SEQ ID NO:4.

In one aspect of the nucleic acid molecule disclosed herein, the encoded polypeptide or the catalytically active portion thereof comprises:
(a) a K286C substitution corresponding to SEQ ID NO:4;
(b) a M79V substitution corresponding to SEQ ID NO:4;
(c) a S377Q substitution corresponding to SEQ ID NO:4;
(d) a S80C substitution corresponding to SEQ ID NO:4;
(e) a N260T and a K286C substitution corresponding to SEQ ID NO:4;
(f) a H184V substitution corresponding to SEQ ID NO:4;
(g) a A81W and a E83K substitution corresponding to SEQ ID NO:4
(h) a A81W substitution corresponding to SEQ ID NO:4;
(i) a H184T substitution corresponding to SEQ ID NO:4;
(k) a K286N substitution corresponding to SEQ ID NO:4;
(l) a M79E substitution corresponding to SEQ ID NO:4; or
(m) a K286T substitution corresponding to SEQ ID NO:4.

The invention also provides a nucleic acid molecule encoding a tagged polypeptide or a catalytically active portion thereof capable of glycosylating steviol or a steviol glycoside at its C-19 carboxyl group, wherein the encoded tagged polypeptide or the catalytically active portion thereof comprises a polypeptide having at least 55% sequence identity to the amino acid sequence set forth in SEQ ID NO:174, SEQ ID NO:176, SEQ ID NO:178, or SEQ ID NO:180.

The invention also provides a nucleic acid molecule encoding a bifunctional polypeptide or a catalytically active portion thereof capable of glycosylating steviol or a steviol glycoside at its C-19 carboxyl group and glycosylating steviol or a steviol glycoside at its C-13 hydroxyl group, wherein the encoded bifunctional polypeptide or the catalytically active portion thereof comprises a polypeptide having at least 50% sequence identity to the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148.

In one aspect of the nucleic acid molecule disclosed herein, the nucleic acid is an isolated nucleic acid.

In one aspect of the nucleic acid molecule disclosed herein, the nucleic acid is cDNA.

The invention also provides a polypeptide or a catalytically active portion thereof capable of glycosylating steviol or a steviol glycoside at its C-19 carboxyl group, wherein the polypeptide or the catalytically active portion thereof comprises a polypeptide having at least 55% sequence identity to the amino acid sequence set forth in SEQ ID NO:4, and further comprises a polypeptide having at least one amino acid substitution corresponding to residues 79, 80, 81, 83, 184, 260, 286, or 377 of SEQ ID NO:4.

The invention also provides a polypeptide or a catalytically active portion thereof capable of glycosylating steviol or a steviol glycoside at its C-19 carboxyl group, wherein the polypeptide or the catalytically active portion thereof comprises a polypeptide having at least 55% sequence identity to the amino acid sequence set forth in SEQ ID NO:4, and further comprises a polypeptide having at least one amino acid substitution corresponding to residues 68, 69, 70, 71, 72, 73, 74, 75, 76, 77, 78, 79, 80, 81, 82, or 83 of SEQ ID NO:4.

In one aspect, the polypeptide or the catalytically active portion thereof disclosed herein comprises a M79V, M79E, S80C, A81W, E83K, H184V, H184T N260T, K286C, K286E, K286N, K286T, and/or S377Q amino acid substitution corresponding to SEQ ID NO:4.

In one aspect, the polypeptide or the catalytically active portion thereof disclosed herein comprises:
(a) a K286C substitution corresponding to SEQ ID NO:4;
(b) a M79V substitution corresponding to SEQ ID NO:4;
(c) a S377Q substitution corresponding to SEQ ID NO:4;
(d) a S80C substitution corresponding to SEQ ID NO:4;
(e) a N260T and a K286C substitution corresponding to SEQ ID NO:4;
(f) a H184V substitution corresponding to SEQ ID NO:4;
(g) a A81W and a E83K substitution corresponding to SEQ ID NO:4
(h) a A81W substitution corresponding to SEQ ID NO:4;
(i) a H184T substitution corresponding to SEQ ID NO:4;
(k) a K286N substitution corresponding to SEQ ID NO:4;
(l) a M79E substitution corresponding to SEQ ID NO:4; or
(m) a K286T substitution corresponding to SEQ ID NO:4.

The invention also provides a tagged polypeptide or a catalytically active portion thereof capable of glycosylating steviol or a steviol glycoside at its C-19 carboxyl group, wherein the tagged polypeptide or the catalytically active portion thereof comprises a polypeptide having at least 55% sequence identity to the amino acid sequence set forth in SEQ ID NO:174, SEQ ID NO:176, SEQ ID NO:178, or SEQ ID NO:180.

The invention also provides a bifunctional polypeptide or a catalytically active portion thereof capable of glycosylating steviol or a steviol glycoside at its C-19 carboxyl group and glycosylating steviol or a steviol glycoside at its C-13 hydroxyl group, wherein the bifunctional polypeptide or the catalytically active portion thereof comprises a polypeptide having at least 50% sequence identity to the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148.

In one aspect, the polypeptide or the catalytically active portion thereof disclosed herein is a purified polypeptide or a catalytically active portion thereof.

These and other features and advantages of the present invention will be more fully understood from the following detailed description taken together with the accompanying claims. It is noted that the scope of the claims is defined by

BRIEF DESCRIPTION OF THE DRAWINGS

FIG. 14 (bottom graph) shows accumulation of glycosylated ent-kaurenoic acid and glycosylated ent-kaurenol by steviol glycoside-producing *S. cerevisiae* strains expressing tagged UGT74G1 polypeptides (Strains 3 and 4). See Example 9. For legend, see description of FIG. 13. For each variant (for each bar) of the bottom graph, the portions of the bar correspond to, from bottom to top, ent-kaurenoic acid+2Glc (#7), ent-kaurenoic acid+3Glc (isomer 1), ent-kaurenoic acid+3Glc (isomer 2), ent-kaurenol+2Glc (#8), and ent-kaurenol+3Glc (isomers 1 and 2) accumulation.

FIGS. 15A, 15B, and 15C show a $^1$H NMR spectrum and $^1$H and $^{13}$C NMR chemical shifts (in ppm) for ent-kaurenoic acid+3Glc (isomer 1). FIGS. 15D, 15E, and 15F show a $^1$H NMR spectrum and $^1$H and $^{13}$C NMR chemical shifts (in ppm) for ent-kaurenoic acid+3Glc (isomer 2). FIGS. 15G, 15H, and 15I show a $^1$H NMR spectrum and $^1$H and $^{13}$C NMR chemical shifts (in ppm) for ent-kaurenol+3Glc (isomer 1). FIGS. 15J, 15K, 15L, and 15M show a $^1$H NMR spectrum and $^1$H and $^{13}$C NMR chemical shifts (in ppm) for steviol+6Glc (isomer 1).

Figure 1:
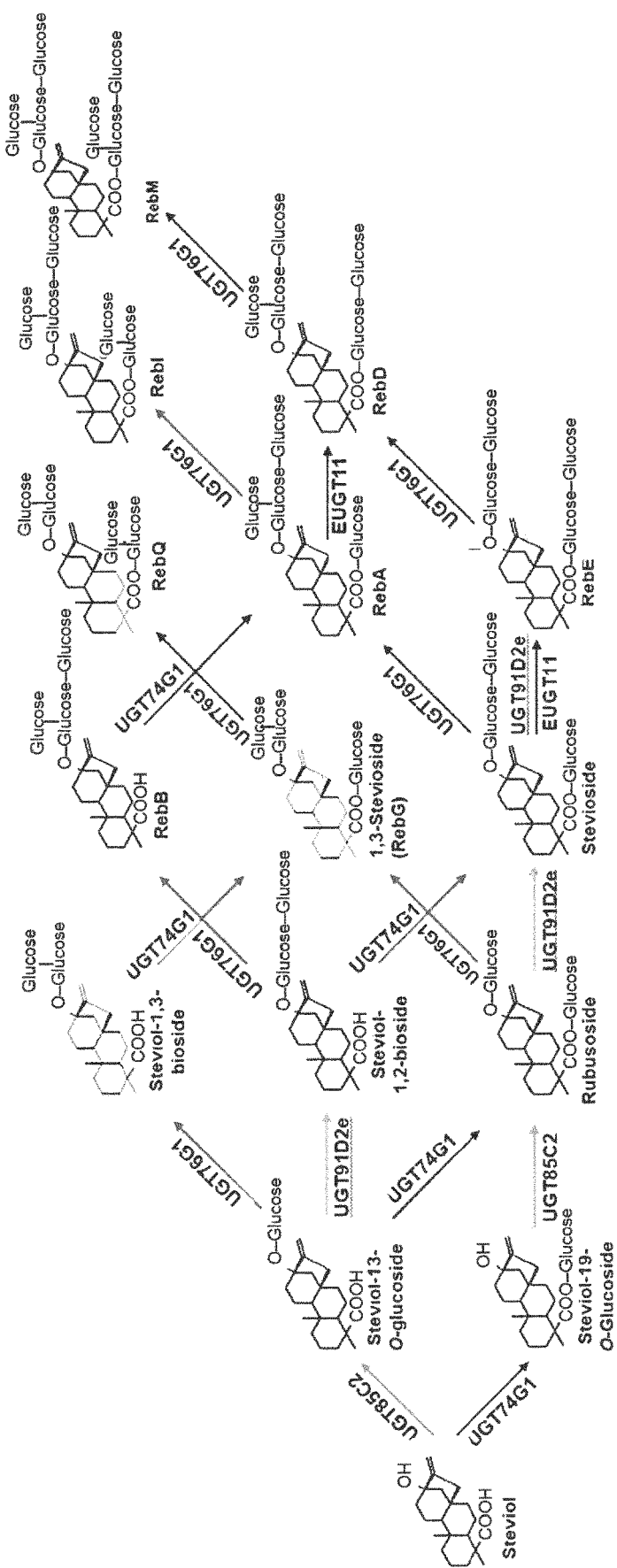
FIG. 1 shows representative primary steviol glycoside glycosylation reactions catalyzed by suitable UGT enzymes and chemical structures for several steviol glycoside compounds.

Skilled artisans will appreciate that elements in the Figures are illustrated for simplicity and clarity and have not necessarily been drawn to scale. For example, the dimensions of some of the elements in the Figures can be exag-

DETAILED DESCRIPTION OF THE INVENTION

All publications, patents and patent applications cited herein are hereby expressly incorporated by reference for all purposes.

Before describing the present invention in detail, a number of terms will be defined. As used herein, the singular forms "a," "an," and "the" include plural referents unless the context clearly dictates otherwise. For example, reference to a "nucleic acid" means one or more nucleic acids.

It is noted that terms like "preferably," "commonly," and "typically" are not utilized herein to limit the scope of the claimed invention or to imply that certain features are critical, essential, or even important to the structure or function of the claimed invention. Rather, these terms are merely intended to highlight alternative or additional features that can or cannot be utilized in a particular embodiment of the present invention.

For the purposes of describing and defining the present invention it is noted that the term "substantially" is utilized herein to represent the inherent degree of uncertainty that can be attributed to any quantitative comparison, value, measurement, or other representation. The term "substantially" is also utilized herein to represent the degree by which a quantitative representation can vary from a stated reference without resulting in a change in the basic function of the subject matter at issue.

Methods well known to those skilled in the art can be used to construct genetic expression constructs and recombinant cells according to this invention. These methods include in vitro recombinant DNA techniques, synthetic techniques, in vivo recombination techniques, and polymerase chain reaction (PCR) techniques. See, for example, techniques as described in Green & Sambrook, 2012, MOLECULAR CLONING: A LABORATORY MANUAL, Fourth Edition, Cold Spring Harbor Laboratory, New York; Ausubel et al., 1989, CURRENT PROTOCOLS IN MOLECULAR BIOLOGY, Greene Publishing Associates and Wiley Interscience, New York, and PCR Protocols: A Guide to Methods and Applications (Innis et al., 1990, Academic Press, San Diego, Calif.).

As used herein, the terms "polynucleotide," "nucleotide," "oligonucleotide," and "nucleic acid" can be used interchangeably to refer to nucleic acid comprising DNA, RNA, derivatives thereof, or combinations thereof, in either single-stranded or double-stranded embodiments depending on context as understood by the skilled worker.

As used herein, the terms "microorganism," "microorganism host," and "microorganism host cell" can be used interchangeably. As used herein, the terms "recombinant host" and "recombinant host cell" can be used interchangeably. The person of ordinary skill in the art will appreciate that the terms "microorganism," microorganism host," and "microorganism host cell," when used to describe a cell comprising a recombinant gene, may be taken to mean "recombinant host" or "recombinant host cell." As used herein, the term "recombinant host" is intended to refer to a host, the genome of which has been augmented by at least one DNA sequence. Such DNA sequences include but are not limited to genes that are not naturally present, DNA sequences that are not normally transcribed into RNA or translated into a protein ("expressed"), and other genes or DNA sequences which one desires to introduce into a host. It will be appreciated that typically the genome of a recombinant host described herein is augmented through stable introduction of one or more recombinant genes. Generally, introduced DNA is not originally resident in the host that is the recipient of the DNA, but it is within the scope of this disclosure to isolate a DNA segment from a given host, and to subsequently introduce one or more additional copies of that DNA into the same host, e.g., to enhance production of the product of a gene or alter the expression pattern of a gene. In some instances, the introduced DNA will modify or even replace an endogenous gene or DNA sequence by, e.g., homologous recombination or site-directed mutagenesis. Suitable recombinant hosts include microorganisms.

As used herein, the term "recombinant gene" refers to a gene or DNA sequence that is introduced into a recipient host, regardless of whether the same or a similar gene or DNA sequence may already be present in such a host. "Introduced," or "augmented" in this context, is known in the art to mean introduced or augmented by the hand of man. Thus, a recombinant gene can be a DNA sequence from another species or can be a DNA sequence that originated from or is present in the same species but has been incorporated into a host by recombinant methods to form a recombinant host. It will be appreciated that a recombinant gene that is introduced into a host can be identical to a DNA sequence that is normally present in the host being transformed, and is introduced to provide one or more additional copies of the DNA to thereby permit overexpression or modified expression of the gene product of that DNA. In some aspects, said recombinant genes are encoded by cDNA. In other embodiments, recombinant genes are synthetic and/or codon-optimized for expression in *S. cerevisiae*.

As used herein, the term "engineered biosynthetic pathway" refers to a biosynthetic pathway that occurs in a recombinant host, as described herein. In some aspects, one or more steps of the biosynthetic pathway do not naturally occur in an unmodified host. In some embodiments, a heterologous version of a gene is introduced into a host that comprises an endogenous version of the gene.

As used herein, the term "endogenous" gene refers to a gene that originates from and is produced or synthesized within a particular organism, tissue, or cell. In some embodiments, the endogenous gene is a yeast gene. In some embodiments, the gene is endogenous to *S. cerevisiae*, including, but not limited to *S. cerevisiae* strain S288C. In some embodiments, an endogenous yeast gene is overexpressed. As used herein, the term "overexpress" is used to refer to the expression of a gene in an organism at levels higher than the level of gene expression in a wild type organism. See, e.g., Prelich, 2012, *Genetics* 190:841-54. In some embodiments, an endogenous yeast gene, for example ADH, is deleted. See, e.g., Giaever & Nislow, 2014, *Genetics* 197(2):451-65. As used herein, the terms "deletion," "deleted," "knockout," and "knocked out" can be used interchangeably to refer to an endogenous gene that has been manipulated to no longer be expressed in an organism, including, but not limited to, *S. cerevisiae*.

As used herein, the terms "heterologous sequence" and "heterologous coding sequence" are used to describe a sequence derived from a species other than the recombinant host. In some embodiments, the recombinant host is an *S. cerevisiae* cell, and a heterologous sequence is derived from an organism other than *S. cerevisiae*. A heterologous coding sequence, for example, can be from a prokaryotic microorganism, a eukaryotic microorganism, a plant, an animal, an insect, or a fungus different than the recombinant host expressing the heterologous sequence. In some embodiments, a coding sequence is a sequence that is native to the host.

A "selectable marker" can be one of any number of genes that complement host cell auxotrophy, provide antibiotic resistance, or result in a color change. Linearized DNA fragments of the gene replacement vector then are introduced into the cells using methods well known in the art (see below). Integration of the linear fragments into the genome and the disruption of the gene can be determined based on the selection marker and can be verified by, for example, PCR or Southern blot analysis. Subsequent to its use in selection, a selectable marker can be removed from the genome of the host cell by, e.g., Cre-LoxP systems (see, e.g., Gossen et al., 2002, *Ann. Rev. Genetics* 36:153-173 and U.S. 2006/0014264). Alternatively, a gene replacement vector can be constructed in such a way as to include a portion of the gene to be disrupted, where the portion is devoid of any endogenous gene promoter sequence and encodes none, or an inactive fragment of, the coding sequence of the gene.

As used herein, the terms "variant" and "mutant" are used to describe a protein sequence that has been modified at one or more amino acids, compared to the wild-type sequence of a particular protein.

As used herein, the term "inactive fragment" is a fragment of the gene that encodes a protein having, e.g., less than about 10% (e.g., less than about 9%, less than about 8%, less than about 7%, less than about 6%, less than about 5%, less than about 4%, less than about 3%, less than about 2%, less than about 1%, or 0%) of the activity of the protein produced from the full-length coding sequence of the gene. Such a portion of a gene is inserted in a vector in such a way that no known promoter sequence is operably linked to the gene sequence, but that a stop codon and a transcription termination sequence are operably linked to the portion of the gene sequence. This vector can be subsequently linearized in the portion of the gene sequence and transformed into a cell. By way of single homologous recombination, this linearized vector is then integrated in the endogenous counterpart of the gene with inactivation thereof.

As used herein, the term "steviol glycoside" refers to Rebaudioside A (RebA) (CAS #58543-16-1), Rebaudioside B (RebB) (CAS #58543-17-2), Rebaudioside C (RebC) (CAS #63550-99-2), Rebaudioside D (RebD) (CAS #63279-13-0), Rebaudioside E (RebE) (CAS #63279-14-1), Rebaudioside F (RebF) (CAS #438045-89-7), Rebaudioside M (RebM) (CAS #1220616-44-3), rubusoside (CAS #63849-39-4), Dulcoside A (CAS #64432-06-0), Rebaudioside I (RebI) (MassBank Record: FU000332), Rebaudioside Q (RebQ), 1,2-stevioside (CAS #57817-89-7), 1,3-stevioside (RebG), steviol-1,2-bioside (MassBank Record: FU000299), steviol-1,3-bioside, steviol-13-O-glucoside (13-SMG), steviol-19-O-glucoside (19-SMG), a tri-glycosylated steviol glycoside, a tetra-glycosylated steviol glycoside, a penta-glycosylated steviol glycoside, a hexa-glycosylated steviol glycoside, a hepta-glycosylated steviol glycoside, and isomers thereof. See FIG. 1; see also, Steviol Glycosides Chemical and Technical Assessment 69th JECFA, 2007, prepared by Harriet Wallin, Food Agric. Org. Nuclear magnetic resonance (NMR) spectra for steviol glycoside isomers disclosed herein can be found in FIG. 15.

Figure 2:
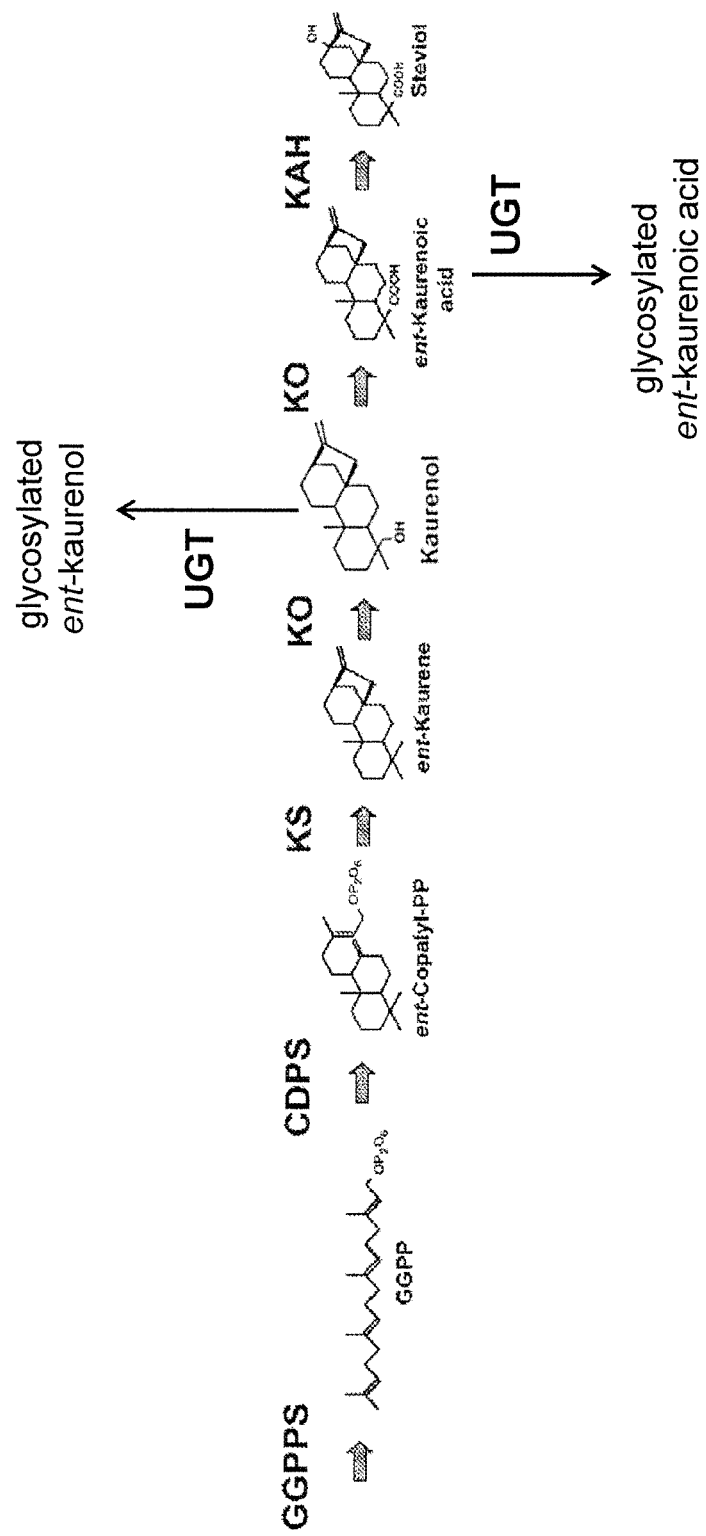
FIG. 2 shows the biochemical pathway for the production of steviol, glycosylated ent-kaurenoic acid, and glycosylated ent-kaurenol from prenyl phosphates.

As used herein, the terms "steviol glycoside precursor" and "steviol glycoside precursor compound" are used to refer to intermediate compounds in the steviol glycoside biosynthetic pathway. Steviol glycoside precursors include, but are not limited to, geranylgeranyl diphosphate (GGPP), ent-copalyl-diphosphate, ent-kaurene, ent-kaurenol, ent-kaurenal, ent-kaurenoic acid, and steviol. See FIG. 2. Also as used herein, the terms "steviol precursor" and "steviol precursor compound" are used to refer to intermediate compounds in the steviol biosynthetic pathway. Steviol precursors may also be steviol glycoside precursors, and include, but are not limited to, geranylgeranyl diphosphate (GGPP), ent-copalyl-diphosphate, ent-kaurene, ent-kaurenol, ent-kaurenal, and ent-kaurenoic acid. In some embodiments, steviol precurors can be glycosylated, e.g., tri-glycosylated ent-kaurenoic acid (ent-kaurenoic acid+3Glc), di-glycosylated ent-kaurenoic acid, mono-glycosylated ent-kaurenoic acid, tri-glycosylated ent-kaurenol, di-glycosylated ent-kaurenol (ent-kaurenol+2Glc), or mono-glycosylated ent-kaurenol (ent-kaurenol+1Glc). In some embodiments, steviol glycoside precursors are themselves steviol glycoside compounds. For example, 19-SMG, rubusoside, stevioside, and RebE are steviol glycoside precursors of RebM. See FIG. 1.

As used herein, the term "contact" is used to refer to any physical interaction between two objects. For example, the term "contact" may refer to the interaction between an an enzyme and a substrate. In another example, the term "contact" may refer to the interaction between a liquid (e.g., a supernatant) and an adsorbent resin.

Steviol glycosides, steviol glycoside precursors, and/or glycosides of steviol precursors can be produced in vivo (i.e., in a recombinant host), in vitro (i.e., enzymatically), or by whole cell bioconversion. As used herein, the terms "produce" and "accumulate" can be used interchangeably to describe synthesis of steviol glycosides, glycosides of steviol precursors, and steviol glycoside precursors in vivo, in vitro, or by whole cell bioconversion.

Recombinant steviol glycoside-producing *Saccharomyces cerevisiae* (*S. cerevisiae*) strains are described in WO 2011/153378, WO 2013/022989, WO 2014/122227, and WO 2014/122328. Methods of producing steviol glycosides in recombinant hosts, by whole cell bio-conversion, and in vitro are also described in WO 2011/153378, WO 2013/022989, WO 2014/122227, and WO 2014/122328.

As used herein, the terms "culture broth," "culture medium," and "growth medium" can be used interchangeably to refer to a liquid or solid that supports growth of a cell. A culture broth can comprise glucose, fructose, sucrose, trace metals, vitamins, salts, yeast nitrogen base (YNB), and/or amino acids. The trace metals can be divalent cations, including, but not limited to, $Mn^{2+}$ and/or $Mg^{2+}$. In some embodiments, $Mn^{2+}$ can be in the form of $MnCl_2$ dihydrate and range from approximately 0.01 g/L to 100 g/L. In some embodiments, $Mg^{2+}$ can be in the form of $MgSO_4$ heptahydrate and range from approximately 0.01 g/L to 100 g/L. For example, a culture broth can comprise i) approximately 0.02-0.03 g/L $MnCl_2$ dihydrate and approximately 0.5-3.8 g/L $MgSO_4$ heptahydrate, ii) approximately 0.03-0.06 g/L $MnCl_2$ dihydrate and approximately 0.5-3.8 g/L $MgSO_4$ heptahydrate, and/or iii) approximately 0.03-0.17 g/L $MnCl_2$ dihydrate and approximately 0.5-7.3 g/L $MgSO_4$ heptahydrate. Additionally, a culture broth can comprise one or more steviol glycosides produced by a recombinant host, as described herein.

In some embodiments, a recombinant host comprising a gene encoding a polypeptide capable of synthesizing geranylgeranyl pyrophosphate (GGPP) from farnesyl diphosphate (FPP) and isopentenyl diphosphate (IPP) (e.g., geranylgeranyl diphosphate synthase (GGPPS)); a gene encoding a polypeptide capable of synthesizing ent-copalyl diphosphate from GGPP (e.g., ent-copalyl diphosphate synthase (CDPS)); a gene encoding a polypeptide capable of synthesizing ent-kaurene from ent-copalyl diphosphate (e.g., kaurene synthase (KS)); a gene encoding a polypeptide capable of synthesizing ent-kaurenoic acid, ent-kaurenol, and/or ent-kaurenal from ent-kaurene (e.g., kaurene oxidase (KO)); a gene encoding a polypeptide capable of reducing cytochrome P450 complex (e.g., cytochrome P450 reductase (CPR) or P450 oxidoreductase (POR); for example, but not limited to a polypeptide capable of electron transfer from NADPH to cytochrome P450 complex during conversion of NADPH to NADP$^+$, which is utilized as a cofactor for terpenoid biosynthesis); a gene encoding a polypeptide capable of synthesizing steviol from ent-kaurenoic acid (e.g., steviol synthase (KAH)); and/or a gene encoding a bifunctional polypeptide capable of synthesizing ent-copalyl diphosphate from GGPP and synthesizing ent-kaurene from ent-copalyl diphosphate (e.g., an ent-copalyl diphosphate synthase (CDPS)—ent-kaurene synthase (KS) polypeptide) can produce steviol in vivo. See, e.g., FIG. 1. The skilled worker will appreciate that one or more of these genes can be endogenous to the host provided that at least one (and in some embodiments, all) of these genes is a recombinant gene introduced into the recombinant host.

In some embodiments, a recombinant host comprising a gene encoding a polypeptide capable of glycosylating steviol or a steviol glycoside at its C-13 hydroxyl group (e.g., a UGT85C2 polypeptide); a gene encoding a polypeptide capable of beta 1,3 glycosylation of the C3' of the 13-O-glucose, 19-O-glucose, or both 13-O-glucose and 19-O-glucose of a steviol glycoside (e.g., a UGT76G1 polypeptide); a gene encoding a polypeptide capable of glycosylating steviol or a steviol glycoside at its C-19 carboxyl group (e.g., a UGT74G1 polypeptide); and/or a gene encoding a polypeptide capable of beta 1,2 glycosylation of the C2' of the 13-O-glucose, 19-O-glucose, or both 13-O-glucose and 19-O-glucose of a steviol glycoside (e.g., a UGT91D2 or EUGT11 polypeptide) can produce a steviol glycoside in vivo. The skilled worker will appreciate that one or more of these genes can be endogenous to the host provided that at least one (and in some embodiments, all) of these genes is a recombinant gene introduced into the recombinant host.

In some embodiments, steviol glycosides, glycosides of steviol precursors, and/or steviol glycoside precursors are produced in vivo through expression of one or more enzymes involved in the steviol glycoside biosynthetic pathway in a recombinant host. For example, a recombinant host comprising a gene encoding a polypeptide capable of synthesizing GGPP from FPP and IPP; a gene encoding a polypeptide capable of synthesizing ent-copalyl diphosphate from GGPP; a gene encoding a polypeptide capable of synthesizing ent-kaurene from ent-copalyl diphosphate; a gene encoding a polypeptide capable of synthesizing ent-kaurenoic acid, ent-kaurenol, and/or ent-kaurenal from ent-kaurene; a gene encoding a polypeptide capable of reducing cytochrome P450 complex; a gene encoding a bifunctional polypeptide capable of synthesizing ent-copalyl diphosphate from GGPP and synthesizing ent-kaurene from ent-copalyl diphosphate; a gene encoding a polypeptide capable of glycosylating steviol or a steviol glycoside at its C-13 hydroxyl group; a gene encoding a polypeptide capable of beta 1,3 glycosylation of the C3' of the 13-O-glucose, 19-O-glucose, or both 13-O-glucose and 19-O-glucose of a steviol glycoside; a gene encoding a polypeptide capable of glycosylating steviol or a steviol glycoside at its C-19 carboxyl group; and/or a gene encoding a polypeptide capable of beta 1,2 glycosylation of the C2' of the 13-O-glucose, 19-O-glucose, or both 13-O-glucose and 19-O-glucose of a steviol glycoside can produce a steviol glycoside and/or steviol glycoside precursors in vivo. See, e.g., FIGS. 1 and 2. The skilled worker will appreciate that one or more of these genes can be endogenous to the host provided that at least one (and in some embodiments, all) of these genes is a recombinant gene introduced into the recombinant host.

In some aspects, the polypeptide capable of synthesizing GGPP from FPP and IPP comprises a polypeptide having an amino acid sequence set forth in SEQ ID NO:20 (which can be encoded by the nucleotide sequence set forth in SEQ ID NO:19), SEQ ID NO:22 (encoded by the nucleotide sequence set forth in SEQ ID NO:21), SEQ ID NO:24 (encoded by the nucleotide sequence set forth in SEQ ID NO:23), SEQ ID NO:26 (encoded by the nucleotide sequence set forth in SEQ ID NO:25), SEQ ID NO:28 (encoded by the nucleotide sequence set forth in SEQ ID NO:27), SEQ ID NO:30 (encoded by the nucleotide sequence set forth in SEQ ID NO:29), SEQ ID NO:32 (encoded by the nucleotide sequence set forth in SEQ ID NO:31), or SEQ ID NO:116 (encoded by the nucleotide sequence set forth in SEQ ID NO:115).

In some aspects, the polypeptide capable of synthesizing ent-copalyl diphosphate from GGPP comprises a polypeptide having an amino acid sequence set forth in SEQ ID NO:34 (which can be encoded by the nucleotide sequence set forth in SEQ ID NO:33), SEQ ID NO:36 (encoded by the nucleotide sequence set forth in SEQ ID NO:35), SEQ ID NO:38 (encoded by the nucleotide sequence set forth in SEQ ID NO:37), SEQ ID NO:40 (encoded by the nucleotide sequence set forth in SEQ ID NO:39), or SEQ ID NO:42 (encoded by the nucleotide sequence set forth in SEQ ID NO:41). In some embodiments, the polypeptide capable of synthesizing ent-copalyl diphosphate from GGPP lacks a chloroplast transit peptide.

In some aspects, the polypeptide capable of synthesizing ent-kaurene from ent-copalyl pyrophosphate comprises a polypeptide having an amino acid sequence set forth in SEQ ID NO:44 (which can be encoded by the nucleotide sequence set forth in SEQ ID NO:43), SEQ ID NO:46 (encoded by the nucleotide sequence set forth in SEQ ID NO:45), SEQ ID NO:48 (encoded by the nucleotide sequence set forth in SEQ ID NO:47), SEQ ID NO:50 (encoded by the nucleotide sequence set forth in SEQ ID NO:49), or SEQ ID NO:52 (encoded by the nucleotide sequence set forth in SEQ ID NO:51).

In some embodiments, a recombinant host comprises a gene encoding a bifunctional polypeptide capable of synthesizing ent-copalyl diphosphate from GGPP and synthesizing ent-kaurene from ent-copalyl pyrophosphate. In some aspects, the bifunctional polypeptide comprises a polypeptide having an amino acid sequence set forth in SEQ ID NO:54 (which can be encoded by the nucleotide sequence set forth in SEQ ID NO:53), SEQ ID NO:56 (encoded by the nucleotide sequence set forth in SEQ ID NO:55), or SEQ ID NO:58 (encoded by the nucleotide sequence set forth in SEQ ID NO:57).

In some aspects, the polypeptide capable of synthesizing ent-kaurenoic acid, ent-kaurenol, and/or ent-kaurenal from ent-kaurene comprises a polypeptide having an amino acid sequence set forth in SEQ ID NO:60 (which can be encoded by the nucleotide sequence set forth in SEQ ID NO:59), SEQ ID NO:62 (encoded by the nucleotide sequence set forth in SEQ ID NO:61), SEQ ID NO:117 (encoded by the nucleotide sequence set forth in SEQ ID NO:63 or SEQ ID NO:64), SEQ ID NO:66 (encoded by the nucleotide sequence set forth in SEQ ID NO:65), SEQ ID NO:68

(encoded by the nucleotide sequence set forth in SEQ ID NO:67), SEQ ID NO:70 (encoded by the nucleotide sequence set forth in SEQ ID NO:69), SEQ ID NO:72 (encoded by the nucleotide sequence set forth in SEQ ID NO:71), SEQ ID NO:74 (encoded by the nucleotide sequence set forth in SEQ ID NO:73), or SEQ ID NO:76 (encoded by the nucleotide sequence set forth in SEQ ID NO:75).

In some aspects, the polypeptide capable of reducing cytochrome P450 complex comprises a polypeptide having an amino acid sequence set forth in SEQ ID NO:78 (which can be encoded by the nucleotide sequence set forth in SEQ ID NO:77), SEQ ID NO:80 (encoded by the nucleotide sequence set forth in SEQ ID NO:79), SEQ ID NO:82 (encoded by the nucleotide sequence set forth in SEQ ID NO:81), SEQ ID NO:84 (encoded by the nucleotide sequence set forth in SEQ ID NO:83), SEQ ID NO:86 (encoded by the nucleotide sequence set forth in SEQ ID NO:85), SEQ ID NO:88 (encoded by the nucleotide sequence set forth in SEQ ID NO:87), SEQ ID NO:90 (encoded by the nucleotide sequence set forth in SEQ ID NO:89), or SEQ ID NO:92 (encoded by the nucleotide sequence set forth in SEQ ID NO:91).

In some aspects, the polypeptide capable of synthesizing steviol from ent-kaurenoic acid comprises a polypeptide having an amino acid sequence set forth in SEQ ID NO:94 (which can be encoded by the nucleotide sequence set forth in SEQ ID NO:93), SEQ ID NO:97 (encoded by the nucleotide sequence set forth in SEQ ID NO:95 or SEQ ID NO:96), SEQ ID NO:100 (encoded by the nucleotide sequence set forth in SEQ ID NO:98 or SEQ ID NO:99), SEQ ID NO:101, SEQ ID NO:102, SEQ ID NO:103, SEQ ID NO:104, SEQ ID NO:106 (encoded by the nucleotide sequence set forth in SEQ ID NO:105), SEQ ID NO:108 (encoded by the nucleotide sequence set forth in SEQ ID NO:107), SEQ ID NO:110 (encoded by the nucleotide sequence set forth in SEQ ID NO:109), SEQ ID NO:112 (encoded by the nucleotide sequence set forth in SEQ ID NO:111), or SEQ ID NO:114 (encoded by the nucleotide sequence set forth in SEQ ID NO:113).

In some embodiments, a recombinant host comprises a nucleic acid encoding a polypeptide capable of glycosylating steviol or a steviol glycoside at its C-13 hydroxyl group (e.g., UGT85C2 polypeptide; SEQ ID NO:7), a nucleic acid encoding a polypeptide capable of beta 1,3 glycosylation of the C3' of the 13-O-glucose, 19-O-glucose, or both 13-O-glucose and 19-O-glucose of a steviol glycoside (e.g., UGT76G1 polypeptide; SEQ ID NO:9), a nucleic acid encoding a polypeptide capable of glycosylating steviol or a steviol glycoside at its C-19 carboxyl group (e.g., UGT74G1 polypeptide; SEQ ID NO:4), a nucleic acid encoding a polypeptide capable of beta 1,2 glycosylation of the C2' of the 13-O-glucose, 19-O-glucose, or both 13-O-glucose and 19-O-glucose of a steviol glycoside (e.g., EUGT11 polypeptide; SEQ ID NO:16). In some aspects, the polypeptide capable of beta 1,2 glycosylation of the C2' of the 13-O-glucose, 19-O-glucose, or both 13-O-glucose and 19-O-glucose of a steviol glycoside (e.g., UGT91D2 polypeptide) can be a UGT91D2e polypeptide (SEQ ID NO:11) or a UGT91D2e-b polypeptide (SEQ ID NO:13).

In some aspects, the polypeptide capable of glycosylating steviol or a steviol glycoside at its C-13 hydroxyl group is encoded by the nucleotide sequence set forth in SEQ ID NO:5 or SEQ ID NO:6, the polypeptide capable of beta 1,3 glycosylation of the C3' of the 13-O-glucose, 19-O-glucose, or both 13-O-glucose and 19-O-glucose of a steviol glycoside is encoded by the nucleotide sequence set forth in SEQ ID NO:8, the polypeptide capable of glycosylating steviol or a steviol glycoside at its C-19 carboxyl group is encoded by the nucleotide sequence set forth in SEQ ID NO:3, the polypeptide capable of beta 1,2 glycosylation of the C2' of the 13-O-glucose, 19-O-glucose, or both 13-O-glucose and 19-O-glucose of a steviol glycoside is encoded by the nucleotide sequence set forth in SEQ ID NO:10, 12, 14, or 15. The skilled worker will appreciate that expression of these genes may be necessary to produce a particular steviol glycoside, but that one or more of these genes can be endogenous to the host provided that at least one (and in some embodiments, all) of these genes is a recombinant gene introduced into the recombinant host.

In a particular embodiment, a steviol-producing recombinant microorganism comprises exogenous nucleic acids encoding a polypeptide capable of glycosylating steviol or a steviol glycoside at its C-13 hydroxyl group, a polypeptide capable of beta 1,3 glycosylation of the C3' of the 13-O-glucose, 19-O-glucose, or both 13-O-glucose and 19-O-glucose of a steviol glycoside, and a polypeptide capable of beta 1,2 glycosylation of the C2' of the 13-O-glucose, 19-O-glucose, or both 13-O-glucose and 19-O-glucose of a steviol glycoside polypeptides.

In another particular embodiment, a steviol-producing recombinant microorganism comprises exogenous nucleic acids encoding a polypeptide capable of glycosylating steviol or a steviol glycoside at its C-13 hydroxyl group; a polypeptide capable of beta 1,3 glycosylation of the C3' of the 13-O-glucose, 19-O-glucose, or both 13-O-glucose and 19-O-glucose of a steviol glycoside; a polypeptide capable of glycosylating steviol or a steviol glycoside at its C-19 carboxyl group; and a polypeptide capable of beta 1,2 glycosylation of the C2' of the 13-O-glucose, 19-O-glucose, or both 13-O-glucose and 19-O-glucose of a steviol glycoside.

In some embodiments, steviol glycosides, glycosides of steviol precursors, and/or steviol glycoside precursors are produced through contact of a steviol glycoside precursor with one or more enzymes involved in the steviol glycoside pathway in vitro. For example, contacting steviol with one or more of a gene encoding a polypeptide capable of beta 1,3 glycosylation of the C3' of the 13-O-glucose, 19-O-glucose, or both 13-O-glucose and 19-O-glucose of a steviol glycoside, a polypeptide capable of beta 1,2 glycosylation of the C2' of the 13-O-glucose, 19-O-glucose, or both 13-O-glucose and 19-O-glucose of a steviol glycoside, and a polypeptide capable of glycosylating steviol or a steviol glycoside at its C-13 hydroxyl group or a polypeptide capable of glycosylating steviol or a steviol glycoside at its C-19 carboxyl group can result in production of a steviol glycoside in vitro. In some embodiments, a steviol glycoside precursor is produced through contact of an upstream steviol glycoside precursor with one or more enzymes involved in the steviol glycoside pathway in vitro. For example, contacting ent-kaurenoic acid with a polypeptide capable of synthesizing steviol from ent-kaurenoic acid can result in production of steviol in vitro.

In some embodiments, a steviol glycoside or steviol glycoside precursor is produced by whole cell bioconversion. For whole cell bioconversion to occur, a host cell expressing one or more enzymes involved in the steviol glycoside pathway takes up and modifies the steviol glycoside or steviol glycoside precursor in the cell; following modification in vivo, the steviol glycoside or steviol glycoside precursor remains in the cell and/or is excreted into the cell culture medium. For example, a host cell expressing a gene encoding a polypeptide capable of glycosylating steviol or a steviol glycoside at its C-13 hydroxyl group; a gene encoding a polypeptide capable of beta 1,3 glycosylation of the C3' of the 13-O-glucose, 19-O-glucose, or both 13-O-glucose and 19-O-glucose of a steviol glycoside; a gene encoding a polypeptide capable of glycosylating steviol or a steviol glycoside at its C-19 carboxyl group; and/or a gene encoding a polypeptide capable of beta 1,2 glycosylation of the C2' of the 13-O-glucose, 19-O-glucose, or both 13-O-glucose and 19-O-glucose of a steviol glycoside can take up steviol and glycosylate steviol in the cell; following glycosylation in vivo, a steviol glycoside can be excreted into the culture medium. In certain such embodiments, the host cell may further express a gene encoding a polypeptide capable of synthesizing GGPP from FPP and IPP; a gene encoding a polypeptide capable of synthesizing ent-copalyl diphosphate from GGPP; a gene encoding a polypeptide capable of synthesizing ent-kaurene from ent-copalyl diphosphate; a gene encoding a polypeptide capable of synthesizing ent-kaurenoic acid, ent-kaurenol, and/or ent-kaurenal from ent-kaurene; a gene encoding a polypeptide capable of reducing cytochrome P450 complex; a gene encoding a polypeptide capable of synthesizing steviol from ent-kaurenoic acid; and/or a gene encoding a bifunctional polypeptide capable of synthesizing ent-copalyl diphosphate from GGPP and synthesizing ent-kaurene from ent-copalyl diphosphate.

In some embodiments, a polypeptide capable of glycosylating steviol or a steviol glycoside at its C-19 carboxyl group can be displayed on the surface of the recombinant host cells disclosed herein by fusing it with anchoring motifs.

In some embodiments, the cell is permeabilized to take up a substrate to be modified or to excrete a modified product. In some embodiments, a permeabilizing agent can be added to aid the feedstock entering into the host and product getting out. In some embodiments, the cells are permeabilized with a solvent such as toluene, or with a detergent such as Triton-X or Tween. In some embodiments, the cells are permeabilized with a surfactant, for example a cationic surfactant such as cetyltrimethylammonium bromide (CTAB). In some embodiments, the cells are permeabilized with periodic mechanical shock such as electroporation or a slight osmotic shock. For example, a crude lysate of the cultured microorganism can be centrifuged to obtain a supernatant. The resulting supernatant can then be applied to a chromatography column, e.g., a C18 column, and washed with water to remove hydrophilic compounds, followed by elution of the compound(s) of interest with a solvent such as methanol. The compound(s) can then be further purified by preparative HPLC. See also, WO 2009/140394.

In some embodiments, steviol, one or more steviol glycoside precursors, and/or one or more steviol glycosides are produced by co-culturing of two or more hosts. In some embodiments, one or more hosts, each expressing one or more enzymes involved in the steviol glycoside pathway, produce steviol, one or more steviol glycoside precursors, and/or one or more steviol glycosides. For example, a host expressing a gene encoding a polypeptide capable of synthesizing GGPP from FPP and IPP; a gene encoding a polypeptide capable of synthesizing ent-copalyl diphosphate from GGPP; a gene encoding a polypeptide capable of synthesizing ent-kaurene from ent-copalyl diphosphate; a gene encoding a polypeptide capable of synthesizing ent-kaurenoic acid, ent-kaurenol, and/or ent-kaurenal from ent-kaurene; a gene encoding a polypeptide capable of reducing cytochrome P450 complex; a gene encoding a polypeptide capable of synthesizing steviol from ent-kaurenoic acid; and/or a gene encoding a bifunctional polypeptide capable of synthesizing ent-copalyl diphosphate from GGPP and synthesizing ent-kaurene from ent-copalyl diphosphate and a host expressing a gene encoding a polypeptide capable of glycosylating steviol or a steviol glycoside at its C-13 hydroxyl group; a gene encoding a polypeptide capable of beta 1,3 glycosylation of the C3' of the 13-O-glucose, 19-O-glucose, or both 13-O-glucose and 19-O-glucose of a steviol glycoside; a gene encoding a polypeptide capable of glycosylating steviol or a steviol glycoside at its C-19 carboxyl group; and/or a gene encoding a polypeptide capable of beta 1,2 glycosylation of the C2' of the 13-O-glucose, 19-O-glucose, or both 13-O-glucose and 19-O-glucose of a steviol glycoside, produce one or more steviol glycosides.

In some embodiments, polypeptides capable of glycosylating steviol or a steviol glycoside at its C-19 carboxyl group in vitro, in a recombinant host (i.e., in vivo) or by whole cell bioconversion include functional homologs of UGT74G1 (SEQ ID NO:4) (i.e., UGT74G1 homologs). In some embodiments, polypeptides capable of glycosylating a steviol precursor, e.g., ent-kaurenoic acid at its C-19 carboxyl group and/or ent-kaurenol at its C-19 hydroxyl group in vitro, in a recombinant host, or by whole cell bioconversion include functional homologs of UGT74G1 (SEQ ID NO:4). In some embodiments, polypeptides capable of glycosylating a steviol precursor, e.g., ent-kaurenol, at its C-19 carboxyl group in vitro, in a recombinant host (i.e., in vivo) or by whole cell bioconversion include functional homologs of a polypeptide capable of glycosylating steviol or a steviol glycoside at its C-13 hydroxyl group (e.g., UGT85C2 polypeptide; SEQ ID NO:7).

In some embodiments, polypeptides suitable for producing (i.e., capable of synthesizing) steviol glycosides and/or glycosides of steviol precursors, such as 13-SMG, steviol-1,2-bioside, rubusoside, RebB, RebA, RebE, RebD, RebM, 19-SMG, steviol-1,3-bioside, 1,2-stevioside, 1,3-stevioside, steviol+4GLc (#26 and/or #33), steviol+5Glc (#24 and/or #25), steviol+6Glc (isomer 1 and/or #23), steviol+7Glc (isomer 2 and/or isomer 5), ent-kaurenoic acid+2Glc (#7), ent-kaurenoic acid+3Glc (isomer 1 and/or isomer 2), and/or ent-kaurenol+3Glc (isomer 1 and/or isomer 2), in vitro, in a recombinant host, or by whole cell bioconversion include functional homologs of UGT74G1 (SEQ ID NO:4), such as UGT74G1 Var_1 (SEQ ID NO:118), UGT74G1 Var_2 (SEQ ID NO:120), UGT74G1 Var_3 (SEQ ID NO:122), UGT74G1 Var_4 (SEQ ID NO:124), UGT74G1 Var_5 (SEQ ID NO:126), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10 (SEQ ID NO:165), UGT74G1 Var_11 (SEQ ID NO:167), and UGT74G1 Var_12 (SEQ ID NO:169).

In some embodiments, a useful UGT74G1 functional homolog can have one or more amino acid substitutions corresponding to residues 18, 20, 21, 23, 79, 80, 81, 82, 83, 85, 86, 119, 140, 148, 179, 184, 185, 191, 194, 195, 284, 285, 286, 375, 376, 377, or 378 of SEQ ID NO:4. See, Table 2, below. Non-limiting examples of useful UGT74G1 homologs include polypeptides having substitutions (with respect to SEQ ID NO:4) corresponding to residue 79 (e.g., a valine or a glutamic acid corresponding to residue 79); 80 (e.g., a cysteine corresponding to residue 80); 81 (e.g., a tryptophan corresponding to residue 81); 83 (e.g., a lysine corresponding to residue 83); 184 (e.g., a valine or a threonine corresponding to residue 184); 260 (e.g., a threonine corresponding to residue 260); 286 (e.g., a cysteine, an asparagine, a threonine, or a glutamic acid corresponding to residue 286); or 377 (e.g., a glutamine corresponding to residue 377).

In some embodiments, a useful UGT74G1 homolog can have one or more amino acid substitutions corresponding to residues located within A68-E83 region of SEQ ID NO:4, i.e., one or more amino acid substitutions corresponding to residue 68, 69, 70, 71, 72, 73, 74, 75, 76, 77, 78, 79, 80, 81, 82, or 83 of SEQ ID NO:4.

In some embodiments, polypeptides capable of glycosylating steviol or a steviol glycoside at its C-19 carboxyl group (e.g., UGT74G1 homologs) further comprise a tag, e.g., a tag having the amino acid sequence set forth in SEQ ID NO:152, SEQ ID NO:153, SEQ ID NO:154, or SEQ ID NO:155.

In some embodiments, a recombinant host expressing one or more UGT74G1 variants not limited to UGT74G1 Var_10 (SEQ ID NO:165) or UGT74G1 Var_11 (SEQ ID NO:167) accumulates ent-kaurenoic acid+2Glc (#7) in vivo and/or via whole cell bioconversion. In some embodiments, a recombinant host expressing one or more UGT74G1 variants not limited to UGT74G1 Var_10 (SEQ ID NO:165) or UGT74G1 Var_11 (SEQ ID NO:167) accumulates ent-kaurenoic acid+3Glc (isomer 1) in vivo and/or via whole cell bioconversion.

In some embodiments, a recombinant host expressing one or more UGT74G1 variants not limited to UGT74G1 Var_1 (SEQ ID NO:118), UGT74G1 Var_2 (SEQ ID NO:120), UGT74G1 Var_4 (SEQ ID NO:124), UGT74G1 Var_5 (SEQ ID NO:126), UGT74G1 Var_6 (SEQ ID NO:128), UGT74G1 Var_10 (SEQ ID NO:165), or UGT74G1 Var_11 (SEQ ID NO:167) accumulates ent-kaurenoic acid+3Glc (isomer 2) in vivo and/or via whole cell bioconversion. In some embodiments, a recombinant host expressing one or more UGT74G1 variants not limited to UGT74G1 Var_1 (SEQ ID NO:118) accumulates ent-kaurenol+2Glc (#8) in vivo and/or via whole cell bioconversion.

In some embodiments, a recombinant host expressing one or more UGT74G1 variants not limited to UGT74G1 Var_2 (SEQ ID NO:120), UGT74G1 Var_3 (SEQ ID NO:122), UGT74G1 Var_4 (SEQ ID NO:124), UGT74G1 Var_5 (SEQ ID NO:126), UGT74G1 Var_6 (SEQ ID NO:128), or UGT74G1 Var_7 (SEQ ID NO:130) accumulates ent-kaurenol+3Glc (isomer 1 and isomer 2) in vivo and/or via whole cell bioconversion.

In some embodiments, a recombinant host expressing one or more UGT74G1 variants not limited to UGT74G1 Var_3 (SEQ ID NO:122), UGT74G1 Var_4 (SEQ ID NO:124), UGT74G1 Var_5 (SEQ ID NO:126), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10, or UGT74G1 Var_11 (SEQ ID NO:167) accumulates 13-SMG in vivo and/or via whole cell bioconversion. In some embodiments, a recombinant host expressing one or more UGT74G1 variants not limited to UGT74G1 Var_3 (SEQ ID NO:122) or UGT74G1 Var_9 (SEQ ID NO:163) accumulates steviol-1,2-bioside in vivo and/or via whole cell bioconversion.

In some embodiments, a recombinant host expressing one or more UGT74G1 variants not limited to UGT74G1 Var_1 (SEQ ID NO:118) or UGT74G1 Var_3 (SEQ ID NO:122) accumulates steviol-1,3-bioside in vivo and/or via whole cell bioconversion. In some embodiments, a recombinant host expressing one or more UGT74G1 variants not limited to UGT74G1 Var_1 (SEQ ID NO:118), UGT74G1 Var_2 (SEQ ID NO:120), UGT74G1 Var_4 (SEQ ID NO:124), UGT74G1 Var_5 (SEQ ID NO:126), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10 (SEQ ID NO:165), or UGT74G1 Var_11 (SEQ ID NO:167) accumulates rubusoside in vivo and/or via whole cell bioconversion.

In some embodiments, a recombinant host expressing one or more UGT74G1 variants not limited to UGT74G1 Var_6 (SEQ ID NO:128), UGT74G1 Var_7 (SEQ ID NO:130), UGT74G1 Var_8 (SEQ ID NO:161), or UGT74G1 Var_9 (SEQ ID NO:163) accumulates 1,2-stevioside in vivo and/or via whole cell bioconversion.

In some embodiments, a recombinant host expressing one or more UGT74G1 variants not limited to UGT74G1 Var_3 (SEQ ID NO:122), UGT74G1 Var_4 (SEQ ID NO:124), UGT74G1 Var_5 (SEQ ID NO:126), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10 (SEQ ID NO:165), or UGT74G1 Var_11 (SEQ ID NO:167) accumulates RebB in vivo and/or via whole cell bioconversion.

In some embodiments, a recombinant host expressing one or more UGT74G1 variants not limited to UGT74G1 Var_4 (SEQ ID NO:124), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), or UGT74G1 Var_10 (SEQ ID NO:165) accumulates RebA in vivo and/or via whole cell bioconversion.

In some embodiments, a recombinant host expressing one or more UGT74G1 variants not limited to UGT74G1 Var_2 (SEQ ID NO:120) or UGT74G1 Var_4 (SEQ ID NO:124) accumulates RebE in vivo and/or via whole cell bioconversion.

In some embodiments, a recombinant host expressing one or more UGT74G1 variants not limited to UGT74G1 Var_1 (SEQ ID NO:118), UGT74G1 Var_2 (SEQ ID NO:120), UGT74G1 Var_4 (SEQ ID NO:124), UGT74G1 Var_5 (SEQ ID NO:126), UGT74G1 Var_6 (SEQ ID NO:128), UGT74G1 Var_9 (SEQ ID NO:163), UGT74G1 Var_10 (SEQ ID NO:165), or UGT74G1 Var_11 (SEQ ID NO:167) accumulates steviol+4Glc (#26) in vivo and/or via whole cell bioconversion.

In some embodiments, a recombinant host expressing one or more UGT74G1 variants not limited to UGT74G1 Var_3 (SEQ ID NO:122), UGT74G1 Var_7 (SEQ ID NO:130), UGT74G1 Var_8 (SEQ ID NO:161), UGT74G1 Var_9 (SEQ ID NO:163), or UGT74G1 Var_11 (SEQ ID NO:167) accumulates steviol+4Glc (#33) in vivo and/or via whole cell bioconversion.

In some embodiments, a recombinant host expressing one or more UGT74G1 variants not limited to UGT74G1 Var_7 (SEQ ID NO:130), UGT74G1 Var_8 (SEQ ID NO:161), UGT74G1 Var_9 (SEQ ID NO:163), or UGT74G1 Var_11 (SEQ ID NO:167) accumulates RebD in vivo and/or via whole cell bioconversion.

In some embodiments, a recombinant host expressing one or more UGT74G1 variants not limited to UGT74G1 Var_1 (SEQ ID NO:118), UGT74G1 Var_9 (SEQ ID NO:163), or UGT74G1 Var_11 (SEQ ID NO:167) accumulates steviol+5Glc (#24) in vivo and/or via whole cell bioconversion.

In some embodiments, a recombinant host expressing one or more UGT74G1 variants not limited to UGT74G1 Var_8 (SEQ ID NO:161), UGT74G1 Var_9 (SEQ ID NO:163), or UGT74G1 Var_10 (SEQ ID NO:165) accumulates steviol+5Glc (#25) in vivo and/or via whole cell bioconversion.

In some embodiments, a recombinant host expressing one or more UGT74G1 variants not limited to UGT74G1 Var_2 (SEQ ID NO:120), UGT74G1 Var_4 (SEQ ID NO:124), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10 (SEQ ID NO:165), or UGT74G1 Var_11 (SEQ ID NO:167) accumulates RebM in vivo and/or via whole cell bioconversion.

In some embodiments, a recombinant host expressing one or more UGT74G1 variants not limited to UGT74G1 Var_7 (SEQ ID NO:122) or UGT74G1 Var_10 (SEQ ID NO:165) accumulates steviol+6Glc (#23) in vivo and/or via whole cell bioconversion.

In some embodiments, a recombinant host expressing one or more UGT74G1 variants not limited to, UGT74G1 Var_7 (SEQ ID NO:130), UGT74G1 Var_8 (SEQ ID NO:161), UGT74G1 Var_9 (SEQ ID NO:163), UGT74G1 Var_11 (SEQ ID NO:167) accumulates steviol+7Glc (isomer 2) in vivo and/or via whole cell bioconversion.

In some embodiments, a recombinant host expressing one or more UGT74G1 variants not limited to UGT74G1 Var_1 (SEQ ID NO:118), UGT74G1 Var_2 (SEQ ID NO:120), UGT74G1 Var_5 (SEQ ID NO:126), UGT74G1 Var_7 (SEQ ID NO:130) or UGT74G1 Var_9 (SEQ ID NO:163) accumulates steviol+7Glc (isomer 5) in vivo and/or via whole cell bioconversion. See, Tables 4-6 and 8-10.

In some embodiments, expression of UGT74G1 variants that increase accumulation of steviol glycosides and/or glycosides of steviol precursors in a recombinant host, e.g., a steviol-glycoside producing S. cerevisiae strain (see WO 2014/122227, which has been incorporated by reference in its entirety), alter accumulation of ent-kaurenoic acid+2Glc (#7), ent-kaurenoic acid+3Glc (isomer 1 and/or isomer 2), ent-kaurenol+2Glc (#8), ent-kaurenol+3Glc (isomer 1 and/or isomer 2), 13-SMG, 19-SMG, steviol-1,2-bioside, steviol-1,3-bioside, rubusoside, 1,2-stevioside, RebB, RebA, RebE, RebD, RebM, steviol+4Glc (#26 and/or #33), steviol+5Glc (#24 and/or #25), steviol+6Glc (isomer 1), steviol+6Glc (#23), and steviol+7Glc (isomer 2 and/or isomer 5) compared to expression of wild-type UGT74G1 (SEQ ID NO:4) in a recombinant host (e.g. expression of wild-type UGT74G1 in a steviol glycoside-producing S. cerevisiae strain).

In some embodiments, expression of UGT74G1 variants that decrease and/or increase ent-kaurenoic acid+2Glc (#7) accumulation by a recombinant host, e.g., S. cerevisiae, also results in increased accumulation of ent-kaurenoic acid+3Glc (isomer 1), ent-kaurenoic acid+3Glc (isomer 2), 13-SMG, rubusoside, 1,3-stevioside, RebB, RebA, RebD, RebM, steviol+4Glc (#26), steviol+4Glc (#33), steviol+5Glc (#24), steviol+5Glc (#25), steviol+6Glc (isomer 1), steviol+6Glc (#23), and/or steviol+7Glc (isomer 2), but decreased accumulation of RebA, RebD, 1,2-stevioside, steviol+4Glc (#33), steviol+5Glc (#25), steviol+7Glc (isomer 2), and/or steviol+7Glc (isomer 5).

In some embodiments, expression of UGT74G1 variants that increase ent-kaurenoic acid+3Glc (isomer 1) accumulation by a recombinant host, e.g., S. cerevisiae, also results in increased accumulation of ent-kaurenoic acid+2Glc (#7), ent-kaurenoic acid+3Glc (isomer 2), 13-SMG, rubusoside, 1,3-stevioside, RebB, RebA, RebD, RebM, steviol+4Glc (#26), steviol+4Glc (#33), steviol+5Glc (#24), steviol+5Glc (#25), steviol+6Glc (isomer 1), steviol+6Glc (#23), and/or steviol+7Glc (isomer 2), but decreased accumulation of RebA, RebD, 1,2-stevioside, steviol+4Glc (#33), steviol+5Glc (#25), steviol+7Glc (isomer 2), and/or steviol+7Glc (isomer 5).

In some embodiments, expression of UGT74G1 variants that increase ent-kaurenoic acid+3Glc (isomer 2) accumulation by a recombinant host, e.g. S. cerevisiae, also results in increased accumulation of ent-kaurenoic acid+2Glc (#7), ent-kaurenol+2Glc (#8), ent-kaurenol+3Glc (isomer 1 and/or isomer 2), ent-kaurenoic acid+3Glc (isomer 1), 13-SMG, steviol-1,3-bioside, rubusoside, 1,2-stevioside, 1,3-stevioside, RebB, RebA, RebD, RebE, steviol+4Glc (#26), steviol+4Glc (#33), steviol+5Glc (#24), steviol+5Glc (#25), RebM, steviol+6Glc (isomer 1), steviol+6Glc (#23), steviol+7Glc (isomer 2), and/or steviol+7Glc (isomer 5) but decreased accumulation of ent-kaurenoic acid+2Glc (#7), steviol+6Glc (isomer 1), RebA, RebD, 1,2-stevioside, steviol+4Glc (#33), steviol+5Glc (#25), steviol+7Glc (isomer 2), and/or steviol+7Glc (isomer 5).

In some embodiments, expression of a functional homolog of a polypeptide capable of glycosylating steviol or a steviol glycoside at its C-13 hydroxyl group (e.g., a UGT85C2 polypeptide) and/or a functional homolog of a bifunctional polypeptide capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases ent-kaurenol+2Glc (#8) accumulation by a recombinant host also results in increased accumulation of ent-kaurenoic acid+3Glc (isomer 2), steviol-1,3-bioside, rubusoside, steviol+4Glc (#26), steviol+5Glc (#24), and/or steviol+7Glc (isomer 5) but decreased accumulation of steviol+6Glc (isomer 1).

In some embodiments, expression of a functional homolog of a bifunctional polypeptide capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases ent-kaurenol+3Glc (isomer 1 and/or isomer 2) accumulation by a recombinant host also results in increased accumulation of ent-kaurenoic acid+3Glc (isomer 2), 13-SMG, steviol-1,2-bioside, steviol-1,3-bioside, rubusoside, 1,2-stevioside, RebB, RebA, RebE, steviol+4Glc (#26 and/or #33), RebD, RebM, steviol+6Glc (#23), and/or steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, 1,2-stevioside, RebA, steviol+4Glc (#26), RebD, steviol+5Glc (#24 and/or #25), steviol+6Glc (isomer 1), RebM, and/or steviol+7Glc (isomer 2 and/or isomer 5).

In some embodiments, expression of UGT74G1 variants that increase 13-SMG accumulation by a recombinant host also results in increased accumulation of ent-kaurenoic acid+2Glc (#7), ent-kaurenoic acid+3Glc (isomer 1), ent-kaurenoic acid+3Glc (isomer 2), ent-kaurenol+3Glc (isomer 1 and/or isomer 2), steviol-1,2-bioside, steviol-1,3-bioside, rubusoside, 1,2-stevioside, RebB, RebE, RebA, steviol+4Glc (#26 and/or #33), RebM, RebD, steviol+5Glc (#24 and/or #25), steviol+6Glc (isomer 1), steviol+6Glc (#23), steviol+7Glc (isomer 2) and/or steviol+7Glc (isomer 5) but decreased accumulation of ent-kaurenoic acid+2Glc (#7), ent-kaurenoic acid+3Glc (isomer 1 and/or isomer 2), 19-SMG, 1,2-stevioside, RebA, steviol+4Glc (#26), steviol+4Glc (#33), RebD, steviol+5Glc (#24 and/or #25), steviol+6Glc (isomer 1), RebM, and/or steviol+7Glc (isomer 2 and/or isomer 5).

In some embodiments, expression of UGT74G1 variants that increase steviol-1,2-bioside accumulation by a recombinant host also results in increased accumulation of ent-kaurenol+3Glc (isomer 1 and/or isomer 2), 13-SMG, steviol-1,3-bioside, rubusoside, 1,2-stevioside, 1,3-stevioside, RebB, RebA, RebD, RebM, steviol+4Glc (#26), steviol+

4Glc (#33), steviol+5Glc (#24 and/or #25), steviol+6Glc (isomer 1), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, 1,2-stevioside, RebA, steviol+4Glc (#26), RebD, steviol+5Glc (#24 and/or #25), steviol+6Glc (isomer 1), RebM, and/or steviol+7Glc (isomer 2 and/or isomer 5).

In some embodiments, expression of UGT74G1 variants that increase steviol-1,3-bioside accumulation by a recombinant host also results in increased accumulation of ent-kaurenoic acid+3Glc (isomer 2), ent-kaurenol+2Glc (#8), ent-kaurenol+3Glc (isomer 1 and/or isomer 2), 13-SMG, steviol-1,2-bioside, rubusoside, RebB, steviol+4Glc (#26 and/or #33), steviol+5Glc (#24), and/or steviol+7Glc (isomer 5) but decreased accumulation of ent-kaurenoic acid+2Glc (#7), ent-kaurenoic acid+3Glc (isomer 1 and/or isomer 2), 19-SMG, 1,2-stevioside, RebA, steviol+4Glc (#26), RebD, steviol+5Glc (#24 and/or #25), steviol+6Glc (isomer 1), RebM, and/or steviol+7Glc (isomer 2 and/or isomer 5).

In some embodiments, expression of UGT74G1 variants that increase rubusoside accumulation by a recombinant host also results in increased accumulation of ent-kaurenoic acid+2Glc (#7), ent-kaurenoic acid+3Glc (isomer 1), ent-kaurenoic acid+3Glc (isomer 2), ent-kaurenol+2Glc (#8), ent-kaurenol+3Glc (isomer 1 and/or isomer 2), 13-SMG, steviol-1,2-bioside, steviol-1,3-bioside, 1,2-stevioside, 1,3-stevioside, RebB, RebA, RebE, steviol+4Glc (#26 and/or #33), RebD, steviol+5Glc (#24 and/or #25), steviol+6Glc (isomer 1), RebM, steviol+6Glc (#23), and/or steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, RebA, RebD, 1,2-stevioside, steviol+4Glc (#33) steviol+5Glc (#24 and/or #25), and/or steviol+7Glc (isomer 2 and/or isomer 5).

In some embodiments, expression of UGT74G1 variants that increase 1,2-stevioside accumulation by a recombinant host also results in increased accumulation of ent-kaurenoic acid+3Glc (isomer 2), ent-kaurenol+3Glc (isomer 1 and/or isomer 2), 13-SMG, steviol-1,2-bioside, 1,3-stevioside, rubusoside, RebB, RebA, steviol+4Glc (#26 and/or #33), steviol+5Glc (#24 and/or #25), RebD, RebM, steviol+6Glc (isomer 1 and/or #23), and/or steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, steviol+4Glc (#26), steviol+5Glc (#24), and/or steviol+7Glc (isomer 5).

In some embodiments, expression of UGT74G1 variants that increase 1,3-stevioside accumulation by a recombinant host also results in increased accumulation of ent-kaurenoic acid+2Glc (#7), ent-kaurenoic acid+3Glc (isomer 1 and/or isomer 2), 13-SMG, steviol-1,2-bioside, rubusoside, RebB, RebA, RebD, RebM, 1,2-stevioside, steviol+4Glc (#26 and/or #33), steviol+5Glc (#24 and/or #25), steviol+6Glc (isomer 1 and/or #23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, RebD, 1,2-stevioside, steviol+4Glc (#26 and/or #33), steviol+5Glc (#24), steviol+7Glc (isomer 2).

In some embodiments, expression of UGT74G1 variants that increase RebB accumulation by a recombinant host also results in increased accumulation of ent-kaurenoic acid+2Glc (#7), ent-kaurenoic acid+3Glc (isomer 1 and/or isomer 2), ent-kaurenol+3Glc (isomer 1 and/or isomer 2), 13-SMG, steviol-1,2-bioside, steviol-1,3-bioside, rubusoside, 1,2-stevioside, RebE, RebA, steviol+4Glc (#26 and/or #33), RebD, RebM, steviol+5Glc (#24 and/or #25), steviol+6Glc (isomer 1), steviol+6Glc (#23), and steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, 1,2-stevioside, RebA, steviol+4Glc (#26 and/or #33), RebD, steviol+5Glc (#24 and/or #25), steviol+6Glc (isomer 1), and/or steviol+7Glc (isomer 2 and/or isomer 5).

In some embodiments, expression of UGT74G1 variants that increase RebA accumulation by a recombinant host also results in increased accumulation of ent-kaurenoic acid+2Glc (#7), ent-kaurenoic acid+3Glc (isomer 1), ent-kaurenoic acid+3Glc (isomer 2), ent-kaurenol+3Glc (isomer 1 and/or isomer 2), 13-SMG, rubusoside, 1,2-stevioside, 1,3-stevioside, steviol-1,2-bioside, RebB, RebE, steviol+4Glc (#26 and/or #33), steviol+5Glc (#24 and/or #25) RebD, RebM, steviol+6Glc (isomer 1 and/or #23), and/or steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, RebD, 1,2-stevioside, steviol+4Glc (#26 and/or #33), steviol+5Glc (#24), and/or steviol+7Glc (isomer 2 and/or isomer 5).

In some embodiments, expression of UGT74G1 variants that increase RebE accumulation by a recombinant host also results in increased accumulation of ent-kaurenoic acid+3Glc (isomer 2), ent-kaurenol+3Glc (isomer 1 and/or isomer 2), 13-SMG, rubusoside, RebB, RebA, steviol+4Glc (#26), RebM, and/or steviol+7Glc (isomer 5) but decreased accumulation of ent-kaurenoic acid+2Glc (#7) and/or steviol+7Glc (isomer 5).

In some embodiments, expression of UGT74G1 variants that increase steviol+4Glc (#26) accumulation by a recombinant host results in increased accumulation of ent-kaurenoic acid+2Glc (#7), ent-kaurenoic acid+3Glc (isomer 1), ent-kaurenoic acid+3Glc (isomer 2), ent-kaurenol+2Glc (#8), ent-kaurenol+3Glc (isomer 1 and/or isomer 2), 13-SMG, steviol-1,2-bioside, steviol-1,3-bioside, rubusoside, 1,2-stevioside, RebB, RebA, RebE, steviol+4Glc #33), steviol+5Glc (#24 and/or #25), steviol+6Glc (isomer 1 and/or #23), RebM, RebD, steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, RebA, RebD, 1,2-stevioside, steviol+4Glc (#33), steviol+5Glc (#25) steviol+6Glc (isomer 1), and/or steviol+7Glc (isomer 2 and/or isomer 5).

In some embodiments, expression of UGT74G1 variants that increase steviol+4Glc (#33) accumulation by a recombinant host results in increased accumulation of ent-kaurenoic acid+2Glc (#7), ent-kaurenoic acid+3Glc (isomer 1), ent-kaurenoic acid+3Glc (isomer 2), ent-kaurenol+3Glc (isomer 1 and/or isomer 2), 13-SMG, steviol-1,2-bioside, steviol-1,3-bioside, rubusoside, 1,2-stevioside, 1,3-stevioside, RebB, RebA, steviol+4Glc (#26), steviol+5Glc (#24 and/or #25), RebD, RebM, steviol+6Glc (isomer 1 and/or #23), and/or steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, 1,2-stevioside, RebA, steviol+4Glc (#26), RebD, steviol+5Glc (#24 and/or #25), steviol+6Glc (isomer 1), RebM, and/or steviol+7Glc (isomer 2 and/or isomer 5).

In some embodiments, expression of UGT74G1 variants that increase RebD accumulation by a recombinant host results in increased accumulation of ent-kaurenoic acid+2Glc (#7), ent-kaurenoic acid+3Glc (isomer 1 and/or isomer 2), ent-kaurenol+3Glc (isomer 1 and/or isomer 2), ent-kaurenol+3Glc (isomer 1 and/or isomer 2), 13-SMG, rubusoside, steviol-1,2-bioside, 1,2-stevioside, 1,3-stevioside, RebB, RebA, steviol+4Glc (#26 and/or #33), RebM, steviol+5Glc (#24 and/or #25), steviol+6Glc (isomer 1 and/or #23), steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, RebA, steviol+4Glc (#26), steviol+5Glc (#24 and/or #25), and/or steviol+7Glc (isomer 5).

In some embodiments, expression of UGT74G1 variants that increase steviol+5Glc (#24) accumulation by a recombinant host results in increased accumulation of ent-kaurenoic acid+2Glc (#7), ent-kaurenoic acid+3Glc (isomer 1 and/or isomer 2), 13-SMG, ent-kaurenol+2Glc (#8), steviol-1,2-bioside, steviol-1,3-bioside, rubusoside, 1,2-stevioside, 1,3-stevioside, RebB, RebA, RebD, RebM, steviol+4Glc (#26 and/or #33), steviol+5Glc (#25), steviol+6Glc (isomer 1), and/or steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, RebA, 1,2-stevioside, steviol+5Glc (#24 and/or #25), steviol+6Glc (isomer 1), and/or steviol+7Glc (isomer 5).

In some embodiments, expression of UGT74G1 variants that increase steviol+5Glc (#25) accumulation by a recombinant host also results in increased accumulation of ent-kaurenoic acid+2Glc (#7), ent-kaurenoic acid+3Glc (isomer 1 and/or isomer 2), 13-SMG, steviol-1,2-bioside, rubusoside, RebB, RebA, RebD, RebM, 1,2-stevioside, 1,3-stevioside, steviol+4Glc (#26 and/or #33), steviol+5Glc (#24), steviol+6Glc (isomer 1 and/or #23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, RebD, 1,2-stevioside, steviol+4Glc (#26 and/or #33), steviol+5Glc (#24), steviol+7Glc (isomer 2).

In some embodiments, expression of UGT74G1 variants that increase RebM accumulation by a recombinant host results in increased accumulation of ent-kaurenoic acid+2Glc (#7), ent-kaurenoic acid+3Glc (isomer 1 and/or isomer 2), ent-kaurenol+3Glc (isomer 1 and/or isomer 2), 13-SMG, rubusoside, 1,2-stevioside, 1,3-stevioside, steviol-1,2-bioside, RebB, RebA, RebE, steviol+4Glc (#26 and/or #33), RebD, steviol+5Glc (#24 and/or #25) steviol+6Glc (isomer 1 and/or #23), and/or steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, RebA, RebD, 1,2-stevioside, steviol+4Glc (#33), steviol+5Glc (#24 and/or #25), and/or steviol+7Glc (isomer 2 and/or isomer 5).

In some embodiments, expression of UGT74G1 variants that increase steviol+6Glc (isomer 1) accumulation by a recombinant host results in increased ent-kaurenoic acid+2Glc (#7), ent-kaurenoic acid+3Glc (isomer 1 and/or isomer 2), 13-SMG, steviol-1,2-bioside, rubusoside, 1,3-stevioside, RebB, RebA, RebD, RebM, 1,2-stevioside, steviol+4Glc (#26 and/or #33), steviol+5Glc (#24 and/or #25), steviol+6Glc (#23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 13-SMG, 19-SMG, steviol-1,2-bioside, rubusoside, 1,3-stevioside, RebB, RebA, RebD, RebM, 1,2-stevioside, steviol+4Glc (#26 and/or #33), steviol+5Glc (#24 and/or #25), and/or steviol+7Glc (isomer 2 and/or isomer 5).

In some embodiments, expression of UGT74G1 variants that increase steviol+6Glc (#23) accumulation by a recombinant host results in increased ent-kaurenoic acid+2Glc (#7), ent-kaurenoic acid+3Glc (isomer 1 and/or isomer 2), ent-kaurenol+3Glc (isomer 1 and/or isomer 2), 13-SMG, rubusoside, 1,2-stevioside, 1,3-stevioside, RebB, RebA, steviol+4Glc (#26 and/or #33), steviol+5Glc (#25), RebM, steviol+6Glc (isomer 1), steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, RebD, 1,2-stevioside, steviol+4Glc (#33), steviol+5Glc (#24), and/or steviol+7Glc (isomer 2).

In some embodiments, expression of UGT74G1 variants that increase steviol+7Glc (isomer 2) accumulation by a recombinant host results in increased accumulation of ent-kaurenoic acid+2Glc (#7), ent-kaurenoic acid+3Glc (isomer 1 and/or isomer 2), ent-kaurenol+3Glc (isomer 1 and/or isomer 2), 13-SMG, rubusoside, 1,2-stevioside, 1,3-stevioside, steviol-1,2-bioside, RebB, RebA, steviol+4Glc (#26 and/or #33), steviol+5Glc (#24 and/or #25) RebM, RebD, steviol+6Glc (isomer 1 and/or #23), steviol+7Glc (isomer 2 and/or isomer 5) but decreased accumulation of ent-kaurenoic acid+2Glc (#7), ent-kaurenoic acid+3Glc (isomer 1 and/or isomer 2), 19-SMG, RebA, steviol+4Glc (#26 and/or #33), steviol+5Glc (#24 and/or #25), and/or steviol+7Glc (isomer 5).

In some embodiments, expression of UGT74G1 variants that increase steviol+7Glc (isomer 5) accumulation by a recombinant host results in increased accumulation of ent-kaurenoic acid+3Glc (isomer 2), ent-kaurenol+2Glc (#8), ent-kaurenol+3Glc (isomer 1 and/or isomer 2), 13-SMG, steviol-1,2-bioside, steviol-1,3-bioside, rubusoside, 1,2-stevioside, RebB, RebA, RebE, steviol+4Glc (#26 and/or #33), RebD, steviol+5Glc (#24 and/or #25), RebM, steviol+6Glc (isomer 1 and/or #23), steviol+7Glc (isomer 2) but decreased accumulation of ent-kaurenoic acid+2Glc (#7), ent-kaurenoic acid+3Glc (isomer 1 and/or isomer 2), 19-SMG, steviol+5Glc (#24), and/or steviol+6Glc (isomer 1).

In some embodiments, expression of UGT74G1 Var_10 (SEQ ID NO:165) and/or UGT74G1 Var_11 (SEQ ID NO:167) results in increased ent-kaurenoic acid+2Glc (#7) accumulation by a recombinant host. In some embodiments, expression of UGT74G1 Var_10 (SEQ ID NO:165) and/or UGT74G1 Var_11 (SEQ ID NO:167) results in increased ent-kaurenoic acid+3Glc (isomer 1) accumulation by a recombinant host.

In some embodiments, expression of UGT74G1 Var_1 (SEQ ID NO:118), UGT74G1 Var_2 (SEQ ID NO:120), UGT74G1 Var_4 (SEQ ID NO:124), UGT74G1 Var_5 (SEQ ID NO:126), UGT74G1 Var_6 (SEQ ID NO:128), UGT74G1 Var_10 (SEQ ID NO:165), and/or UGT74G1 Var_11 (SEQ ID NO:167) results in increased ent-kaurenoic acid+3Glc (isomer 2) accumulation by a recombinant host.

In some embodiments, expression of a functional homolog of a polypeptide capable of glycosylating steviol or a steviol glycoside at its C-13 hydroxyl group (e.g., UGT85C2 polypeptide; SEQ ID NO:7) and/or a functional homolog of a bifunctional polypeptide capable of glycosylating steviol or a steviol glycoside at its C-19 carboxyl group and glycosylating steviol or a steviol glycoside at its C-13 hydroxyl group (UGT74G1-b-UGT85C2 chimeric polypeptide; SEQ ID NO:134, SEQ ID NO:136, SEQ ID NO:144, SEQ ID NO:146, or SEQ ID NO:148 and/or UGT85C2-b-UGT74G1 chimeric polypeptide; SEQ ID NO:132, SEQ ID NO:138, SEQ ID NO:140, or SEQ ID NO:142) results in increased ent-kaurenol+2Glc (#8) accumulation by a recombinant host.

In some embodiments, expression of a functional homolog of a bifunctional polypeptide capable of glycosylating steviol or a steviol glycoside at its C-19 carboxyl group and glycosylating steviol or a steviol glycoside at its C-13 hydroxyl group (UGT74G1-b-UGT85C2 chimeric polypeptide; SEQ ID NO:134, SEQ ID NO:136, SEQ ID NO:144, SEQ ID NO:146, or SEQ ID NO:148 and/or UGT85C2-b-UGT74G1 chimeric polypeptide; SEQ ID NO:132, SEQ ID NO:138, SEQ ID NO:140, or SEQ ID NO:142) results in increased ent-kaurenol+3Glc (isomer 1 and/or isomer 2) accumulation by a recombinant host.

In some embodiments, expression of UGT74G1 Var_3 (SEQ ID NO:122), UGT74G1 Var_4 (SEQ ID NO:124), UGT74G1 Var_5 (SEQ ID NO:126), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10 (SEQ ID NO:165), and/or UGT74G1 Var_11 (SEQ ID NO:167) results in increased 13-SMG accumulation by a recombinant host.

In some embodiments, expression of UGT74G1 Var_3 (SEQ ID NO:122) and/or UGT74G1 Var_9 (SEQ ID NO:163) results in increased steviol-1,2-bioside accumulation by a recombinant host.

In some embodiments, expression of UGT74G1 Var_1 (SEQ ID NO:118) and/or UGT74G1 Var_3 (SEQ ID NO:122) results in increased steviol-1,3-bioside accumulation by a recombinant host. In some embodiments, expression of UGT74G1 Var_1 (SEQ ID NO:118), UGT74G1 Var_2 (SEQ ID NO:120), UGT74G1 Var_4 (SEQ ID NO:124), UGT74G1 Var_5 (SEQ ID NO:126), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10 (SEQ ID NO:165), and/or UGT74G1 Var_11 (SEQ ID NO:167) results in increased rubusoside accumulation by a recombinant host. In some embodiments, expression of UGT74G1 Var_6 (SEQ ID NO:128), UGT74G1 Var_7 (SEQ ID NO:130), UGT74G1 Var_8 (SEQ ID NO:161), and/or UGT74G1 Var_9 (SEQ ID NO:163) results in increased 1,2-stevioside accumulation by a recombinant host.

In some embodiments, expression of UGT74G1 Var_3 (SEQ ID NO:122), UGT74G1 Var_4 (SEQ ID NO:124), UGT74G1 Var_5 (SEQ ID NO:126), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10 (SEQ ID NO:165), and/or UGT74G1 Var_11 (SEQ ID NO:167) results in increased RebB accumulation by a recombinant host.

In some embodiments, expression of UGT74G1 Var_4 (SEQ ID NO:124), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), and/or UGT74G1 Var_10 (SEQ ID NO:165) results in increased RebA accumulation by a recombinant host.

In some embodiments, expression of UGT74G1 Var_4 (SEQ ID NO:124) results in increased RebE accumulation by a recombinant host. In some embodiments, expression of UGT74G1 Var_1 (SEQ ID NO:118), UGT74G1 Var_2 (SEQ ID NO:120), UGT74G1 Var_4 (SEQ ID NO:124), UGT74G1 Var_5 (SEQ ID NO:126), UGT74G1 Var_6 (SEQ ID NO:128), UGT74G1 Var_9 (SEQ ID NO:163), UGT74G1 Var_10 (SEQ ID NO:165), and/or UGT74G1 Var_11 (SEQ ID NO:167) results in increased steviol+4Glc (#26) accumulation by a recombinant host. In some embodiments, expression of UGT74G1 Var_3 (SEQ ID NO:122), UGT74G1 Var_7 (SEQ ID NO:130), UGT74G1 Var_8 (SEQ ID NO:161), UGT74G1 Var_9 (SEQ ID NO:163), and/or UGT74G1 Var_11 (SEQ ID NO:167) results in increased steviol+4Glc (#33) accumulation by a recombinant host.

In some embodiments, expression of UGT74G1 Var_7 (SEQ ID NO:130), UGT74G1 Var_8 (SEQ ID NO:161), UGT74G1 Var_9 (SEQ ID NO:163), and/or UGT74G1 Var_11 (SEQ ID NO:167) results in increased RebD accumulation by a recombinant host.

In some embodiments, expression of UGT74G1 Var_1 (SEQ ID NO:118), UGT74G1 Var_9 (SEQ ID NO:163), and/or UGT74G1 Var_11 (SEQ ID NO:167) results in increased steviol+5Glc (#24) accumulation by a recombinant host.

In some embodiments, expression of UGT74G1 Var_8 (SEQ ID NO:161), UGT74G1 Var_9 (SEQ ID NO:163), and/or UGT74G1 Var_10 (SEQ ID NO:165) results in increased steviol+5Glc (#25) accumulation by a recombinant host. In some embodiments, expression of UGT74G1 Var_2 (SEQ ID NO:120), UGT74G1 Var_4 (SEQ ID NO:124), UGT74G1 Var_6 (SEQ ID NO:128), UGT74G1 Var_7 (SEQ ID NO:130), UGT74G1 Var_8 (SEQ ID NO:161), UGT74G1 Var_9 (SEQ ID NO:163), UGT74G1 Var_10 (SEQ ID NO:165), and/or UGT74G1 Var_11 (SEQ ID NO:167) results in increased RebM accumulation by a recombinant host.

In some embodiments, expression of UGT74G1 Var_8 (SEQ ID NO:161), UGT74G1 Var_9 (SEQ ID NO:163), UGT74G1 Var_10 (SEQ ID NO:165), UGT74G1 Var_11 (SEQ ID NO:167), and/or UGT74G1 Var_12 (SEQ ID NO:169) results in increased steviol+6Glc (isomer 1) accumulation by a recombinant host.

In some embodiments, expression of UGT74G1 Var_7 (SEQ ID NO:130) and/or UGT74G1 Var_10 (SEQ ID NO:165) results in increased steviol+6Glc (#23) accumulation by a recombinant host. In some embodiments, expression of UGT74G1 Var_7 (SEQ ID NO:130), UGT74G1 Var_8 (SEQ ID NO:161), UGT74G1 Var_9 (SEQ ID NO:163), and/or UGT74G1 Var_11 (SEQ ID NO:167) results in increased steviol+7Glc (isomer 2) accumulation by a recombinant host.

In some embodiments, expression of UGT74G1 Var_1 (SEQ ID NO:118), UGT74G1 Var_2 (SEQ ID NO:120), UGT74G1 Var_5 (SEQ ID NO:126), UGT74G1 Var_7 (SEQ ID NO:130), and/or UGT74G1 Var_9 (SEQ ID NO:163) results in increased steviol+7Glc (isomer 5) accumulation by a recombinant host.

In some embodiments, expression of UGT74G1 Var_3 (SEQ ID NO:122), UGT74G1 Var_4 (SEQ ID NO:124), UT74G1 Var_7 (SEQ ID NO:130), UGT74G1 Var_8 (SEQ ID NO:161), UGT74G1 Var_9 (SEQ ID NO:163), and/or UGT74G1 Var_12 (SEQ ID NO:169) results in decreased ent-kaurenoic acid+2Glc (#7) accumulation by a recombinant host.

In some embodiments, expression of UGT74G1 Var_3 (SEQ ID NO:122), UGT74G1 Var_7 (SEQ ID NO:130), UGT74G1 Var_8 (SEQ ID NO:161), UGT74G1 Var_9 (SEQ ID NO:163), and/or UGT74G1 Var_12 (SEQ ID NO:169) results in decreased ent-kaurenoic acid+3Glc (isomer 1) accumulation by a recombinant host.

In some embodiments, expression of UGT74G1 Var_3 (SEQ ID NO:122), UGT74G1 Var_7 (SEQ ID NO:130), UGT74G1 Var_8 (SEQ ID NO:161), UGT74G1 Var_9 (SEQ ID NO:163), and/or UGT74G1 Var_12 (SEQ ID NO:169) results in decreased ent-kaurenoic acid+3Glc (isomer 2) accumulation by a recombinant host.

In some embodiments, expression of UGT74G1 Var_12 (SEQ ID NO:169) results in decreased 13-SMG accumulation by a recombinant host. In some embodiments, expression of UGT74G1 Var_3 (SEQ ID NO:122), UGT74G1 Var_7 (SEQ ID NO:130), UGT74G1 Var_8 (SEQ ID NO:161), UGT74G1 Var_9 (SEQ ID NO:163), and/or UGT74G1 Var_12 (SEQ ID NO:169) results in decreased 19-SMG accumulation by a recombinant host.

In some embodiments, expression of UGT74G1 Var_3 (SEQ ID NO:122), UGT74G1 Var_10 (SEQ ID NO:165), UGT74G1 Var_11 (SEQ ID NO:167), and/or UGT74G1 Var_12 (SEQ ID NO:169) results in decreased 1,2-stevioside accumulation by a recombinant host.

In some embodiments, expression of UGT74G1 Var_12 (SEQ ID NO:169) results in decreased 1,3-stevioside accumulation by a recombinant host. In some embodiments, expression of UGT74G1 Var_12 (SEQ ID NO:169) results in decreased steviol-1,2-bioside accumulation by a recombinant host.

In some embodiments, expression of UGT74G1 Var_12 (SEQ ID NO:169) results in decreased rubusoside accumulation by a recombinant host. In some embodiments, expression of UGT74G1 Var_3 (SEQ ID NO:122) and/or UGT74G1 Var_12 (SEQ ID NO:169) results in decreased RebA accumulation by a recombinant host.

In some embodiments, expression of UGT74G1 Var_12 (SEQ ID NO:169) results in decreased RebB accumulation by a recombinant host. In some embodiments, expression of UGT74G1 Var_3 (SEQ ID NO:122), UGT74G1 Var_8 (SEQ ID NO:161), and/or UGT74G1 Var_12 (SEQ ID NO:169) results in decreased steviol+4Glc (#26) accumulation by a recombinant host.

In some embodiments, expression of UGT74G1 Var_10 (SEQ ID NO:165) and/or UGT74G1 Var_12 (SEQ ID NO:169) results in decreased steviol+4Glc (#33) accumulation by a recombinant host.

In some embodiments, expression of UGT74G1 Var_3 (SEQ ID NO:122), UGT74G1 Var_10 (SEQ ID NO:165), and/or UGT74G1 Var_12 (SEQ ID NO:169) results in decreased RebD accumulation by a recombinant host.

In some embodiments, expression of UGT74G1 Var_3 (SEQ ID NO:122), UGT74G1 Var_7 (SEQ ID NO:130), UGT74G1 Var_8 (SEQ ID NO:161), and/or UGT74G1 Var_12 (SEQ ID NO:169) results in decreased steviol+5Glc (#24) accumulation by a recombinant host.

In some embodiments, expression of UGT74G1 Var_3 (SEQ ID NO:122), UGT74G1 Var_11 (SEQ ID NO:167), and/or UGT74G1 Var_12 (SEQ ID NO:169) results in decreased steviol+5Glc (#25) accumulation by a recombinant host.

In some embodiments, expression of UGT74G1 Var_1 (SEQ ID NO:118) and/or UGT74G1 Var_3 (SEQ ID NO:122) results in decreased steviol+6Glc (isomer 1) accumulation by a recombinant host.

In some embodiments, expression of UGT74G1 Var_3 (SEQ ID NO:122) and/or UGT74G1 Var_12 (SEQ ID NO:169) results in decreased RebM accumulation by a recombinant host.

In some embodiments, expression of UGT74G1 Var_3 (SEQ ID NO:122), UGT74G1 Var_10 (SEQ ID NO:165), and/or UGT74G1 Var_12 (SEQ ID NO:169) results in decreased steviol+7Glc (isomer 2) accumulation by a recombinant host.

In some embodiments, expression of UGT74G1 Var_3 (SEQ ID NO:122), UGT74G1 Var_4 (SEQ ID NO:124), UGT74G1 Var_7 (SEQ ID NO:130), UGT74G1 Var_11 (SEQ ID NO:167), and/or UGT74G1 Var_12 (SEQ ID NO:169) results in decreased steviol+7Glc (isomer 5) accumulation by a recombinant host.

In some embodiments, a bifunctional polypeptide is capable of glycosylating steviol or a steviol glycoside at its C-19 carboxyl group and glycosylating steviol or a steviol glycoside at its C-13 hydroxyl group. In some embodiments, a bifunctional polypeptide capable of glycosylating steviol or a steviol glycoside at its C-19 carboxyl group and glycosylating steviol or a steviol glycoside at its C-13 hydroxyl group comprises a polypeptide capable of glycosylating steviol or a steviol glycoside at its C-19 carboxyl group (e.g., a UGT74G1 polypeptide) and a polypeptide capable of glycosylating steviol or a steviol glycoside at its C-13 hydroxyl group (e.g., a UGT85C2 polypeptide) joined through a linker (i.e., a chimeric enzyme, or a fusion polypeptide). In some embodiments, the polypeptide capable of glycosylating steviol or a steviol glycoside at its C-19 carboxyl group is capable of glycosylating a steviol precursor, e.g., ent-kaurenoic acid at its C-19 carboxyl group and/or ent-kaurenol at its C-19 hydroxyl group.

In some embodiments, the C-terminal of a polypeptide capable of glycosylating steviol or a steviol glycoside at its C-19 carboxyl group is joined to the N-terminal of a polypeptide capable of glycosylating steviol or a steviol glycoside at its C-13 hydroxyl group through a linker to provide the bifunctional polypeptide. In some embodiments, the C-terminal of a polypeptide capable of glycosylating steviol or a steviol glycoside at its C-13 hydroxyl group is joined to the N-terminal of a polypeptide capable of glycosylating steviol or a steviol glycoside at its C-19 carboxyl group through a linker to provide the bifunctional polypeptide. In some embodiments, the linker may be the amino acid sequence "KLVK" (SEQ ID NO:191). In some embodiments, the linker may the amino acid sequence "EGKSSGSGSESKST" (SEQ ID NO:151). In some embodiments, the linker is the amino acid sequence RASST-KLVK" (SEQ ID NO:150). In some embodiments, the linker is the amino acid sequence "GGGGS" (SEQ ID NO:192). In some embodiments, the linker is two repeates of the amino acid sequence "GGGGS" (SEQ ID NO:192) (i.e., "GGGGSGGGGS" (SEQ ID NO:193)). In some embodiments, the linker is three repeats of the amino acid sequence "GGGGS" (SEQ ID NO:192). In some embodiments, the linker is a direct bond (i.e., between the C-terminal of a first polypeptide and the N-terminal of a second polypeptide).

In some embodiments, polypeptides capable of glycosylating steviol or a steviol glycoside at its C-13 hydroxyl and at its C-19 carboxyl group in vitro, in a recombinant host (i.e., in vivo) or by whole cell bioconversion include bifunctional polypeptides comprising a functional homolog of UGT74G1 (SEQ ID NO:4) joined to a functional homolog of UGT85C2 (SEQ ID NO:7) through a linker ("b"), i.e., UGT74G1-b-UGT85C2 or UGT85C2-b-UGT74G1.

In some embodiments, bifunctional polypeptides capable of glycosylating steviol or a steviol glycoside at its C-19 carboxyl group and glycosylating steviol or a steviol glycoside at its C-13 hydroxyl group (e.g., UGT74G1-b-UGT85C2 or UGT85C2-b-UGT74G1) further comprise a tag, e.g., a tag having the amino acid sequence set forth in SEQ ID NO:152, SEQ ID NO:153, SEQ ID NO:154, or SEQ ID NO:155.

In some embodiments, polypeptides suitable for producing (i.e., capable of synthesizing) steviol glycosides and/or glycosides of steviol precursors, such as 13-SMG, steviol-1,2-bioside, rubusoside, RebB, RebA, RebE, RebD, RebM, 19-SMG, steviol-1,3-bioside, 1,2-stevioside, 1,3-stevioside, steviol+4GLc (#26 and/or #33), steviol+5Glc (#24 and/or #25), steviol+6Glc (isomer 1 and/or #23), steviol+7Glc (isomer 2 and/or isomer 5), ent-kaurenoic acid+2Glc (#7), ent-kaurenoic acid+3Glc (isomer 1 and/or isomer 2), and/or ent-kaurenol+3Glc (isomer 1 and/or isomer 2) in a recombinant host include UGT74G1-b-UT85C2 chimeric enzymes, such as Chim_2 (SEQ ID NO:134), Chim_3 (SEQ ID NO:136), Chim_7 (SEQ ID NO:144), Chim_8 (SEQ ID NO:146), or Chim_9 (SEQ ID NO:148).

In some embodiments, a recombinant host expressing Chim_2 (SEQ ID NO:134) accumulates ent-kaurenol+3Glc (isomer 1 and/or isomer 2) and/or 13-SMG in vivo and/or via whole cell bioconversion. In some embodiments, a recombinant host expressing Chim_3 (SEQ ID NO:136) accumulates 13-SMG, RebB, and/or steviol+4Glc (#33) in vivo and/or via whole cell bioconversion. In some embodiments, a recombinant host expressing Chim_7 (SEQ ID NO:144) accumulates ent-kaurenol+3Glc (isomer 1 and 2), 13-SMG, steviol-1,2-bioside, steviol-1,3-bioside, RebB, and/or steviol+4Glc (#33) in vivo and/or via whole cell bioconversion. In some embodiments, a recombinant host expressing Chim_8 (SEQ ID NO:146) accumulates 13-SMG, steviol-1,2-bioside, steviol-1,3-bioside, RebB, and/or steviol+4Glc (#33) in vivo and/or via whole cell bioconversion. In some embodiments, a recombinant host expressing Chim_9 (SEQ ID NO:148) accumulates ent-kaurenol+3Glc (isomer 1 and 2), 19-SMG, steviol-1,3-bioside, rubusoside, 1,2-steviosiode, RebB, steviol+4Glc (#26), and/or steviol+5Glc (#24 and/or #25) in vivo and/or via whole cell bioconversion. See, Tables 8-10.

In some embodiments, polypeptides suitable for producing (i.e., capable of synthesizing) steviol glycosides and/or glycosides of steviol precursors, such as ent-kaurenol+3Glc (#33), 13-SMG, rubusoside, steviol-1,2-bioside, steviol-1,3-bioside, 1,2-steviosiode, RebB, Reb A, RebE, steviol+4Glc (#33) RebD, RebM, steviol+6Glc (#23), and/or steviol+7Glc (isomer 2) in a recombinant host include UGT85C2-b-UT74G1 chimeric enzymes, such as Chim_1 (SEQ ID NO:132), Chim_4 (SEQ ID NO:138), Chim_5 (SEQ ID NO:140), or Chim_6 (SEQ ID NO:142).

In some embodiments, a recombinant host expressing Chim_1 (SEQ ID NO:132) accumulates ent-kaurenol+3Glc (isomer 1 and/or isomer 2), 13-SMG, rubusoside, and/or RebB in vivo and/or via whole cell bioconversion. In some embodiments, a recombinant host expressing Chim_4 (SEQ ID NO:138) accumulates 13-SMG, steviol-1,3-bioside, rubusoside, RebB, RebA, RebE, steviol+4Glc (#33), RebD, RebM, steviol+6Glc (#23), and/or steviol+7Glc (isomer 2) in vivo and/or via whole cell bioconversion. In some embodiments, a recombinant host expressing Chim_5 (SEQ ID NO:140) accumulates ent-kaurenol+3Glc (isomer 1 and/or isomer 2), 13-SMG, rubusoside, RebB, RebE, and/or steviol+4Glc (#33) in vivo and/or via whole cell bioconversion. In some embodiments, a recombinant host expressing Chim_6 (SEQ ID NO:142) accumulates ent-kaurenol+3Glc (isomer 1 and/or isomer 2), 13-SMG, steviol-1,3-bioside, rubusoside, and/or steviol+4Glc (#33) in vivo and/or via whole cell bioconversion. See, Tables 8-10.

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases ent-kaurenol+3Glc (isomer 1 and/or isomer 2) accumulation by a recombinant host results in increased accumulation of 13-SMG, steviol-1,2-bioside, steviol-1,3-bioside, rubusoside, 1,2-steviosiode, RebB, RebA, RebE, steviol+4Glc (#26 and/or #33), steviol+5Glc (#24 and/or #25) but decreased accumulation of ent-kaurenoic acid+2Glc (#7), ent-kaurenoic acid+3Glc (isomer 1 and/or isomer 2), 19-SMG, RebA, steviol+4Glc (#26), RebD, steviol+5Glc (#24 and/or #25), steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases 13-SMG accumulation by a recombinant host results in increased accumulation of ent-kaurenol+3Glc (isomer 1 and/or isomer 2), steviol-1,2-bioside, steviol-1,3-bioside, rubusoside, 1,2-steviosiode, RebB, RebE, steviol+4Glc (#33), RebD, steviol+5Glc (#24 and/or #25), RebM, steviol+6Glc (#23), and/or steviol+7Glc (isomer 2) but decreased accumulation of ent-kaurenoic acid+2Glc (#7), ent-kaurenoic acid+3Glc (isomer 1 and/or isomer 2), 19-SMG, 1,2-steviosiode, RebA, steviol+4Glc (#26), RebD, steviol+5Glc (#24 and/or #25), steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases 19-SMG accumulation by a recombinant host results in increased accumulation of ent-kaurenol+3Glc (isomer 1 and/or isomer 2), steviol-1,3-bioside, rubusoside, 1,2-steviosiode, RebB, steviol+4Glc (#26), and/or steviol+5Glc (#24 and/or #25) but decreased accumulation of ent-kaurenoic acid+2Glc (#7), ent-kaurenoic acid+3Glc (isomer 1), RebD, steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases steviol-1,2-bioside accumulation by a recombinant host results in increased accumulation of ent-kaurenol+3Glc (isomer 1 and/or isomer 2), 13-SMG, steviol-1,3-bioside, RebB, and/or steviol+4Glc (#33) but decreased accumulation of ent-kaurenoic acid+2Glc (#7), ent-kaurenoic acid+3Glc (isomer 1 and/or isomer 2), 19-SMG, 1,2-steviosiode, RebA, RebD, steviol+5Glc (#24), steviol+6Glc (isomer 1), RebM, and/or steviol+7Glc (isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases steviol-1,3-bioside accumulation by a recombinant host results in increased accumulation of ent-kaurenol+3Glc (isomer 1 and/or isomer 2), 13-SMG, 19-SMG, steviol-1,2-bioside, rubusoside, 1,2-steviosiode, RebB, RebA, RebE, steviol+4Glc (#26 and/or #33), RebD, steviol+5Glc (#24 and/or #25), RebM, steviol+6Glc (#23), and/or steviol+7Glc (isomer 2) but decreased accumulation of ent-kaurenoic acid+2Glc (#7), ent-kaurenoic acid+3Glc (isomer 1 and/or isomer 2), 19-SMG, 1,2-steviosiode, RebA, RebD, steviol+5Glc (#24), steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases rubusoside accumulation by a recombinant host results in increased accumulation of ent-kaurenol+3Glc (isomer 1 and/or isomer 2), 13-SMG, 19-SMG, steviol-1,3-bioside, 1,2-stevioside, RebB, RebA, RebE, steviol+4Glc (#26 and/or #33), RebD, steviol+5Glc (#24 and/or #25), RebM, steviol+6Glc (#23), and/or steviol+7Glc (isomer 2) but decreased accumulation of ent-kaurenoic acid+2Glc (#7), ent-kaurenoic acid+3Glc (isomer 1 and/or isomer 2), 19-SMG, RebD, steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases 1,2-stevioside accumulation by a recombinant host results in increased accumulation of ent-kaurenol+3Glc (isomer 1 and/or isomer 2), 19-SMG, steviol-1,3-bioside, rubusoside, RebB, steviol+4Glc (#26), and/or steviol+5Glc (#24 and/or #25) but decreased accumulation of ent-kaurenoic acid+2Glc (#7), ent-kaurenoic acid+3Glc (isomer 1), RebD, steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases RebB accumulation by a recombinant host results in increased accumulation of ent-kaurenol+3Glc (isomer 1 and/or isomer 2), 13-SMG, 19-SMG, steviol-1,2-bioside, steviol-1,3-bioside, rubusoside, 1,2-stevioside, RebA, RebE, steviol+4Glc (#26 and/or #33), RebD, steviol+5Glc (#24 and/or #25), RebM, steviol+6Glc (#23), and/or steviol+7Glc (isomer 2) but decreased accumulation of ent-kaurenoic acid+2Glc (#7), ent-kaurenoic acid+3Glc (isomer 1 and/or isomer 2), 19-SMG, 1,2-stevioside, RebA, steviol+4Glc (#26), RebD, steviol+5Glc (#24 and/or #25), steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases RebA accumulation by a recombinant host results in increased accumulation of 13-SMG, steviol-1,3-bioside, rubusoside, RebB, RebE, steviol+4Glc (#33), RebD, RebM, steviol+6Glc (#23), and/or steviol+7Glc (isomer 2) but decreased accumulation of ent-kaurenoic acid+2Glc (#7), ent-kaurenoic acid+3Glc (isomer 1 and/or isomer 2), 19-SMG, and/or steviol+7Glc (isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases RebE accumulation by a recombinant host results in increased accumulation of ent-kaurenol+3Glc (isomer 1 and/or isomer 2), 13-SMG, steviol-1,3-bioside, rubusoside, RebB, RebA, steviol+4Glc (#33), RebD, RebM, steviol+6Glc (#23), and/or steviol+7Glc (isomer 2) but decreased accumulation of ent-kaurenoic acid+2Glc (#7), ent-kaurenoic acid+3Glc (isomer 1 and/or isomer 2), 19-SMG, and/or steviol+7Glc (isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases steviol+4Glc (#26) accumulation by a recombinant host results in increased accumulation of ent-kaurenol+3Glc (isomer 1 and/or isomer 2), 19-SMG, steviol-1,3-bioside, rubusoside, 1,2-stevioside, RebB, and/or steviol+5Glc (#24 and/or #25) but decreased accumulation of ent-kaurenoic acid+2Glc (#7), ent-kaurenoic acid+3Glc (isomer 1), RebD, steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases steviol+4Glc (#33) accumulation by a recombinant host results in increased accumulation of ent-kaurenol+3Glc (isomer 1 and/or isomer 2), 13-SMG, steviol-1,2-bioside, steviol-1,3-bioside, rubusoside, RebB, RebA, RebE, RebD, RebM, steviol+6Glc (#23), and/or steviol+7Glc (isomer 2) but decreased accumulation of kaurenoic acid+2Glc (#7), kaurenoic acid+3Glc (isomer 1 and/or isomer 2), 19-SMG, 1,2-stevioside, RebA, steviol+4Glc (#26), RebD, steviol+5Glc (#24 and/or #25), steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases RebD accumulation by a recombinant host results in increased accumulation of 13-SMG, steviol-1,3-bioside, rubusoside, RebB, RebA, RebE, steviol+4Glc (#33), RebM, steviol+6Glc (#23), and/or steviol+7Glc (isomer 2) but decreased accumulation of ent-kaurenoic acid+2Glc (#7), ent-kaurenoic acid+3Glc (isomer 1 and/or isomer 2), 19-SMG, and/or steviol+7Glc (isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases steviol+4Glc (#24 and/or #25) accumulation by a recombinant host results in increased accumulation of ent-kaurenol+3Glc (isomer 1 and/or isomer 2), 19-SMG, steviol-1,3-bioside, rubusoside, 1,2-stevioside, RebB, and/or steviol+5Glc (#26) but decreased accumulation of ent-kaurenoic acid+2Glc (#7), ent-kaurenoic acid+3Glc (isomer 1), RebD, steviol+6Glc (isomer 1), RebM, and/or steviol+7Glc (isomer 2 and/or isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases RebM accumulation by a recombinant host results in increased accumulation of 13-SMG, steviol-1,3-bioside, rubusoside, RebB, RebA, RebE, steviol+4Glc (#33), RebD, steviol+6Glc (#23), and/or steviol+7Glc (isomer 2) but decreased accumulation of ent-kaurenoic acid+2Glc (#7), ent-kaurenoic acid+3Glc (isomer 1 and/or isomer 2), 19-SMG, and/or steviol+7Glc (isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases steviol+6Glc (#23) accumulation by a recombinant host results in increased accumulation of 13-SMG, steviol-1,3-bioside, rubusoside, RebB, RebA, RebE, steviol+4Glc (#33), RebD, RebM, and/or steviol+7Glc (isomer 2) but decreased accumulation of ent-kaurenoic acid+2Glc (#7), ent-kaurenoic acid+3Glc (isomer 1 and/or isomer 2), 19-SMG, and/or steviol+7Glc (isomer 5).

In some embodiments, expression of a bifunctional polypeptide is capable of glycosylating steviol or a steviol glycoside at its C-19 carboxyl group and glycosylating steviol or a steviol glycoside at its C-13 hydroxyl group (e.g., a UGT74G1-b-UGT85C2 and/or UGT85C2-b-UGT74G1 chimeric enzyme) that increases steviol+7Glc (isomer 2) accumulation by a recombinant host results in increased accumulation of 13-SMG, steviol-1,3-bioside, rubusoside, RebB, RebA, RebE, steviol+4Glc (#33), RebD, RebM, and/or steviol+6Glc (#23) but decreased accumulation of ent-kaurenoic acid+2Glc (#7), ent-kaurenoic acid+3Glc (isomer 1 and/or isomer 2), 19-SMG, steviol+7Glc (isomer 5).

In some embodiments, expression of Chim_1 (SEQ ID NO:132), Chim_2 (SEQ ID NO:134), Chim_5 (SEQ ID NO:140), Chim_6 (SEQ ID NO:142), Chim_7 (SEQ ID NO:144), and/or Chim_9 (SEQ ID NO:148) results in increased ent-kaurenol+3Glc (isomer 1 and/or isomer 2) accumulation by a recombinant host. In some embodiments, expression of Chim_1 (SEQ ID NO:132), Chim_2 (SEQ ID NO:134), Chim_3 (SEQ ID NO:136), Chim_4 (SEQ ID NO:138), Chim_5 (SEQ ID NO:140), Chim_6 (SEQ ID NO:142), Chim_7 (SEQ ID NO:144), and/or Chim_8 (SEQ ID NO:146) results in increased 13-SMG accumulation by a recombinant host. In some embodiments, expression of Chim_9 (SEQ ID NO:148) results in increased 19-SMG accumulation by a recombinant host. In some embodiments, expression of Chim_7 (SEQ ID NO:144) and/or Chim_8 (SEQ ID NO:146) results in increased steviol-1,2-bioside accumulation by a recombinant host. In some embodiments, expression of Chim_4 (SEQ ID NO:138), Chim_6 (SEQ ID NO:142), Chim_7 (SEQ ID NO:144), Chim_8 (SEQ ID NO:146), and/or Chim_9 (SEQ ID NO:148) results in increased steviol-1,3-bioside accumulation by a recombinant host. In some embodiments, expression of Chim_1 (SEQ ID NO:132), Chim_4 (SEQ ID NO:138), Chim_5 (SEQ ID NO:140), Chim_6 (SEQ ID NO:142), and/or Chim_9 (SEQ ID NO:148) results in increased rubusoside accumulation by a recombinant host. In some embodiments, expression of Chim_9 (SEQ ID NO:148) results in increased 1,2-stevioside accumulation by a recombinant host. In some embodiments, expression of Chim_1 (SEQ ID NO:132), Chim_3 (SEQ ID NO:136), Chim_4 (SEQ ID NO:138), Chim_5 (SEQ ID NO:140), Chim_7 (SEQ ID NO:144), Chim_8 (SEQ ID NO:146), and/or Chim_9 (SEQ ID NO:148) results in increased RebB accumulation by a recombinant host. In some embodiments, expression of Chim_4 (SEQ ID NO:138) results in increased RebA accumulation by a recombinant host. In some embodiments, expression of Chim_4 (SEQ ID NO:138) and/or Chim_5 (SEQ ID NO:140) results in increased RebE accumulation by a recombinant host. In some embodiments, expression of Chim_9 (SEQ ID NO:148) results in increased steviol+4Glc (#26) accumulation by a recombinant host. In some embodiments, expression of Chim_1 (SEQ ID NO:132), Chim_3 (SEQ ID NO:136), Chim_4 (SEQ ID NO:138), Chim_5 (SEQ ID NO:140), Chim_6 (SEQ ID NO:142), Chim_7 (SEQ ID NO:144), and/or Chim_8 (SEQ ID NO:146) results in increased RebB accumulation by a recombinant host. In some embodiments, expression of Chim_4 (SEQ ID NO:138) results in increased RebD accumulation by a recombinant host. In some embodiments, expression of Chim_9 (SEQ ID NO:148) results in increased steviol+5Glc (#24) accumulation by a recombinant host. In some embodiments, expression of Chim_9 (SEQ ID NO:148) results in increased steviol+5Glc (#25) accumulation by a recombinant host. In some embodiments, expression of Chim_4 (SEQ ID NO:138) results in increased RebM accumulation by a recombinant host. In some embodiments, expression of Chim_4 (SEQ ID NO:138) results in increased steviol+6Glc (#23) accumulation by a recombinant host. In some embodiments, expression of Chim_4 (SEQ ID NO:138) results in increased steviol+7Glc (isomer 2) accumulation by a recombinant host.

In some embodiments, expression of Chim_1 (SEQ ID NO:132), Chim_2 (SEQ ID NO:134), Chim_3 (SEQ ID NO:136), Chim_4 (SEQ ID NO:138), Chim_5 (SEQ ID NO:140), Chim_6 (SEQ ID NO:142), Chim_7 (SEQ ID NO:144), Chim_8 (SEQ ID NO:146), and/or Chim_9 (SEQ ID NO:148) results in decreased ent-kaurenoic acid+2Glc (#7) accumulation by a recombinant host. In some embodiments, expression of Chim_1 (SEQ ID NO:132), Chim_2 (SEQ ID NO:134), Chim_3 (SEQ ID NO:136), Chim_4 (SEQ ID NO:138), Chim_5 (SEQ ID NO:140), Chim_6 (SEQ ID NO:142), Chim_7 (SEQ ID NO:144), Chim_8 (SEQ ID NO:146), and/or Chim_9 (SEQ ID NO:148) results in decreased ent-kaurenoic acid+3Glc (isomer 1) accumulation by a recombinant host. In some embodiments, expression of Chim_1 (SEQ ID NO:132), Chim_2 (SEQ ID NO:134), Chim_3 (SEQ ID NO:136), Chim_4 (SEQ ID NO:138), Chim_5 (SEQ ID NO:140), Chim_6 (SEQ ID NO:142), Chim_7 (SEQ ID NO:144), and/or Chim_8 (SEQ ID NO:146) results in decreased ent-kaurenoic acid+3Glc (isomer 2) accumulation by a recombinant host. In some embodiments, expression of Chim_1 (SEQ ID NO:132), Chim_2 (SEQ ID NO:134), Chim_3 (SEQ ID NO:136), Chim_4 (SEQ ID NO:138), Chim_5 (SEQ ID NO:140), Chim_6 (SEQ ID NO:142), Chim_7 (SEQ ID NO:144), and/or Chim_8 (SEQ ID NO:146) results in decreased 19-SMG accumulation by a recombinant host. In some embodiments, expression of Chim_3 (SEQ ID NO:136) and/or Chim_8 (SEQ ID NO:146) results in decreased 1,2-stevioside accumulation by a recombinant host. In some embodiments, expression of Chim_2 (SEQ ID NO:134), Chim_3 (SEQ ID NO:136), Chim_7 (SEQ ID NO:144), and/or Chim_8 (SEQ ID NO:146) results in decreased RebA accumulation by a recombinant host. In some embodiments, expression of Chim_2 (SEQ ID NO:134) and/or Chim_3 (SEQ ID NO:136) results in decreased steviol+4Glc (#26) accumulation by a recombinant host. In some embodiments, expression of Chim_2 (SEQ ID NO:134), Chim_3 (SEQ ID NO:136), Chim_7 (SEQ ID NO:144), Chim_8 (SEQ ID NO:146), and/or Chim_9 (SEQ ID NO:148) results in decreased RebD accumulation by a recombinant host. In some embodiments, expression of Chim_5 (SEQ ID NO:132), Chim_2 (SEQ ID NO:134), Chim_3 (SEQ ID NO:136), Chim_7 (SEQ ID NO:144), and/or Chim_8 (SEQ ID NO:146) results in decreased steviol+5Glc (#24) accumulation by a recombinant host. In some embodiments, expression of Chim_2 (SEQ ID NO:134) and/or Chim_3 (SEQ ID NO:136) results in decreased steviol+5Glc (#25) accumulation by a recombinant host. In some embodiments, expression of Chim_3 (SEQ ID NO:136), Chim_7 (SEQ ID NO:144), Chim_8 (SEQ ID NO:146), and/or Chim_9 (SEQ ID NO:148) results in decreased steviol+6Glc (isomer 1) accumulation by a recombinant host. In some embodiments, expression of Chim_2 (SEQ ID NO:134), Chim_3 (SEQ ID NO:136), Chim_7 (SEQ ID NO:144), and/or Chim_9 (SEQ ID NO:148) results in decreased RebM accumulation by a recombinant host. In some embodiments, expression of Chim_3 (SEQ ID NO:136) and/or Chim_9 (SEQ ID NO:148) results in decreased steviol+7Glc (isomer 2) accumulation by a recombinant host. In some embodiments, expression of Chim_1 (SEQ ID NO:132), Chim_2 (SEQ ID NO:134), Chim_3 (SEQ ID NO:136), Chim_4 (SEQ ID NO:138), Chim_5 (SEQ ID NO:140), Chim_6 (SEQ ID NO:142), Chim_7 (SEQ ID NO:144), Chim_8 (SEQ ID NO:146), and/or Chim_9 (SEQ ID NO:148) results in decreased steviol+7Glc (isomer 5) accumulation by a recombinant host.

In some embodiments, polypeptides capable of glycosylating steviol or a steviol glycoside at its C-19 carboxyl group in vitro, in a recombinant host (i.e., in vivo) or by whole cell bioconversion include polypeptides comprising a functional homolog of UGT74G1 (SEQ ID NO:4) and a tag (e.g., a tag having the amino acid sequence set forth in SEQ ID NO:152, SEQ ID NO:153, SEQ ID NO:154, or SEQ ID NO:155), joined through a linker (i.e., a chimeric enzyme, or a fusion polypeptide; i.e., a tagged polypeptide). In some embodiments, the tagged polypeptide capable of glycosylating steviol or a steviol glycoside at its C-19 carboxyl group is capable of glycosylating a steviol precursor, e.g., ent-kaurenoic acid at its C-19 carboxyl group and/or ent-kaurenol at its C-19 hydroxyl group. In some embodiments, the N-terminal of a polypeptide capable of glycosylating steviol or a steviol glycoside at its C-19 carboxyl group is joined to the C-terminal of a tag through a linker to provide the tagged polypeptide. In some embodiments, the linker may the amino acid sequence "EGKSSGSGSESKST" (SEQ ID NO:151). In some embodiments, the linker may be the amino acid sequence "KLVK" (SEQ ID NO:191). In some embodiments, the linker is the amino acid sequence "RASSTKLVK" (SEQ ID NO:150). In some embodiments, the linker is the amino acid sequence "GGGGS" (SEQ ID NO:192). In some embodiments, the linker is two repeates of the amino acid sequence "GGGGS" (SEQ ID NO:192) (i.e., "GGGGSGGGGS" (SEQ ID NO:193)). In some embodiments, the linker is three repeats of the amino acid sequence "GGGGS" (SEQ ID NO:192). In some embodiments, the linker is a direct bond (i.e., between the C-terminal of a first polypeptide and the N-terminal of a tag).

In some embodiments, tagged polypeptides capable of glycosylating steviol or a steviol glycoside at its C-19 carboxyl group in vitro, in a recombinant host (i.e., in vivo) or by whole cell bioconversion include polypeptides comprising a functional homolog of UGT74G1 (SEQ ID NO:4) joined to a tag (e.g., a tag having the amino acid sequence set forth in SEQ ID NO:152, SEQ ID NO:153, SEQ ID NO:154, or SEQ ID NO:155) through a linker (e.g., a linker having the amino acid sequence set forth in SEQ ID NO:151).

In some embodiments, polypeptides suitable for producing (i.e., capable of synthesizing) steviol glycosides and/or glycosides of steviol precursors, such as 13-SMG, steviol-1,2-bioside, steviol-1,3-bioside, 1,2-stevioside, RebB, RebA, RebD, RebM, steviol+5Glc (#24 and/or #25), steviol+6Glc (isomer 1 and/or #23), and/or steviol+7Glc (isomer 2 and/or isomer 5) include tagged polypeptides, such as Chim_10 (SEQ ID NO:174), Chim_11 (SEQ ID NO:176), Chim_12 (SEQ ID NO:178), or Chim_13 (SEQ ID NO:180).

In some embodiments, a recombinant host expressing Chim_10 (SEQ ID NO:174) accumulates 13-SMG, RebD, RebM, steviol+5Glc (#24 and/or #25), steviol+6Glc (isomer 1 and/or #23), and/or steviol+7Glc (isomer 2 and/or isomer 5) in vivo and/or via whole cell bioconversion. In some embodiments, a recombinant host expressing Chim_11 (SEQ ID NO:176) accumulates 13-SMG, RebA, RebD, RebM, 1,2-stevioside, steviol+5Glc (#25), steviol+6Glc (isomer 1 and/or #23), and/or steviol+7Glc (isomer 2) in vivo and/or via whole cell bioconversion. In some embodiments, a recombinant host expressing Chim_12 (SEQ ID NO:178) accumulates 13-SMG, RebA, RebD, RebM, 1,2-stevioside, steviol+5Glc (#24 and #25), steviol+6Glc (isomer 1 and/or #23), and/or steviol+7Glc (isomer 2) in vivo and/or via whole cell bioconversion. In some embodiments, a recombinant host expressing Chim_13 (SEQ ID NO:180) accumulates 13-SMG, steviol-1,2-bioside, RebB, RebA, RebD, RebM, steviol-1,3-bioside, 1,2-stevioside, steviol+5Glc (#25), steviol+6Glc (isomer 1 and/or #23), and/or steviol+7Glc (isomer 2) in vivo and/or via whole cell bioconversion.

In some embodiments, expression of a tagged polypeptide capable of glycosylating steviol or a steviol glycoside at its C-19 carboxyl group (e.g., a tagged UGT74G1 polypeptide) that increases 13-SMG accumulation by a recombinant host results in increased accumulation of steviol-1,2-bioside, RebB, RebA, RebD, RebM, steviol-1,3-bioside, 1,2-stevioside, steviol+5Glc (#24 and/or #25), steviol+6Glc (isomer 1 and/or #23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, RebE, steviol-1,3-bioside, 1,2-stevioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases steviol-1,2-bioside accumulation by a recombinant host results in increased accumulation of 13-SMG, RebB, RebA, RebD, RebM, steviol-1,3-bioside, 1,2-stevioside, steviol+5Glc (#25), steviol+6Glc (isomer 1 and/or #23), and/or steviol+7Glc (isomer 2) but decreased accumulation of of ent-kaurenoic acid+2Glc (#7), ent-kaurenoic acid+3Glc (isomer 1 and/or isomer 2), 19-SMG, rubusoside, RebE, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases RebB accumulation by a recombinant host results in increased accumulation of 13-SMG, RebA, RebD, RebM, steviol-1,2-bioside, steviol-1,3-bioside, 1,2-stevioside, steviol+5Glc (#25), steviol+6Glc (isomer 1 and/or #23), and/or steviol+7Glc (isomer 2) but decreased accumulation of ent-kaurenoic acid+2Glc (#7), ent-kaurenoic acid+3Glc (isomer 1 and/or isomer 2), 19-SMG, rubusoside, RebE, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases RebA accumulation by a recombinant host results in increased accumulation of 13-SMG, steviol-1,2-bioside, RebB, RebD, RebM, steviol-1,3-bioside, 1,2-stevioside, steviol+5Glc (#24 and/or #25), steviol+6Glc (isomer 1 and/or #23), and/or steviol+7Glc (isomer 2), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebE, steviol-1,3-bioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases RebD accumulation by a recombinant host results in increased accumulation of 13-SMG, steviol-1,2-bioside, RebB, RebA, RebM, steviol-1,3-bioside, 1,2-stevioside, steviol+5Glc (#24 and/or #25), steviol+6Glc (isomer 1 and/or #23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, RebE, steviol-1,3-bioside, 1,2-stevioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases RebM accumulation by a recombinant host results in increased accumulation of 13-SMG, steviol-1,2-bioside, RebB, RebA, RebD, steviol-1,3-bioside, 1,2-stevioside, steviol+5Glc (#24 and/or #25), steviol+6Glc (isomer 1 and/or #23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, RebE, steviol-1,3-bioside, 1,2-stevioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases steviol-1,3-bioside accumulation by a recombinant host results in increased accumulation of 13-SMG, RebB, RebA, RebD, RebM, steviol-1,2-bioside, 1,2-stevioside, steviol+5Glc (#25), steviol+6Glc (isomer 1 and/or #23), and/or steviol+7Glc (isomer 2) but decreased accumulation of of ent-kaurenoic acid+2Glc (#7), ent-kaurenoic acid+3Glc (isomer 1 and/or isomer 2), 19-SMG, rubusoside, RebE, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases 1,2-stevioside accumulation by a recombinant host results in increased accumulation of 13-SMG, steviol-1,2-bioside, RebA, RebB, RebD, RebM, steviol-1,3-bioside, steviol+5Glc (#24 and/or #25), steviol+6Glc (isomer 1 and/or #23), and/or steviol+7Glc (isomer 2), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebE, steviol-1,3-bioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases steviol+5Glc (#24) accumulation by a recombinant host results in increased accumulation of 13-SMG, RebA, RebD, RebM, 1,2-stevioside, steviol+5Glc (#25), steviol+6Glc (isomer 1 and/or #23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, RebE, steviol-1,3-bioside, 1,2-stevioside, 1,3-stevioside, steviol+4Glc (#26 and/or #33), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases steviol+5Glc (#25) accumulation by a recombinant host results in increased accumulation of 13-SMG, steviol-1,2-bioside, RebB, RebA, RebD, RebM, steviol-1,3-bioside, 1,2-stevioside, steviol+5Glc (#24), steviol+6Glc (isomer 1 and/or #23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, RebE, steviol-1,3-bioside, 1,2-stevioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases steviol+6Glc (isomer 1) accumulation by a recombinant host results in increased accumulation of 13-SMG, steviol-1,2-bioside, RebB, RebA, RebD, RebM steviol-1,3-bioside, 1,2-stevioside, steviol+5Glc (#24 and/or #25), steviol+6Glc (#23), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, RebE, steviol-1,3-bioside, 1,2-stevioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases steviol+6Glc (#23) accumulation by a recombinant host results in increased accumulation of 13-SMG, steviol-1,2-bioside, RebB, RebA, RebD, RebM steviol-1,3-bioside, 1,2-stevioside, steviol+5Glc (#24 and/or #25), steviol+6Glc (isomer 1), and/or steviol+7Glc (isomer 2 and/or isomer 5), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, RebE, steviol-1,3-bioside, 1,2-stevioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases steviol+7Glc (isomer 2) accumulation by a recombinant host results in increased accumulation of 13-SMG, steviol-1,2-bioside, RebB, RebA, RebD, RebM, steviol-1,3-bioside, 1,2-stevioside, steviol+5Glc (#24 and/or #25), steviol+6Glc (isomer 1 and/or #23), and/or steviol+7Glc (isomer 5), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, RebE, steviol-1,3-bioside, 1,2-stevioside, 1,3-stevioside, steviol+4Glc (#26 and/or #33), steviol+5Glc (#24), and/or steviol+7Glc (isomer 5).

In some embodiments, expression of a tagged polypeptide capable of glycosylating steviol or a steviol glycoside at its C-19 carboxyl group (e.g., a tagged UGT74G1 polypeptide) that increases steviol+7Glc (isomer 5) accumulation by a recombinant host results in increased accumulation of 13-SMG, RebD, RebM, steviol+5Glc (#24 and/or #25), steviol+6Glc (isomer 1 and/or #23), and/or steviol+7Glc (isomer 2), but decreased accumulation of ent-kaurenoic acid+2Glc (#7), ent-kaurenoic acid+3Glc (isomer 1 and/or isomer 2), 19-SMG, steviol-1,2-bioside, rubusoside, RebB, RebA, steviol-1,3-bioside, 1,2-stevioside, 1,3-stevioside, and/or steviol+4Glc (#26 and/or #33).

In some embodiments, expression of Chim_10 (SEQ ID NO:174), Chim_11 (SEQ ID NO:176), Chim_12 (SEQ ID NO:178), and/or Chim_13 (SEQ ID NO:180) results in increased 13-SMG accumulation by a recombinant host. In some embodiments, expression of Chim_13 (SEQ ID NO:180) results in increased steviol-1,2-bioside accumulation by a recombinant host. In some embodiments, expression of Chim_13 (SEQ ID NO:180) results in increased RebB accumulation by a recombinant host. In some embodiments, expression of Chim_11 (SEQ ID NO:176), Chim_12 (SEQ ID NO:178), and/or Chim_13 results in increased RebA accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in increased RebD accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in increased RebM accumulation by a recombinant host. In some embodiments, expression of Chim_13 (SEQ ID NO:180) results in increased steviol-1,3-bioside accumulation by a recombinant host. In some embodiments, expression of Chim_11 (SEQ ID NO:176), Chim_12 (SEQ ID NO:178), and/or Chim_13 (SEQ ID NO:180) results in increased 1,2-stevioside accumulation by a recombinant host. In some embodiments, expression of Chim_10 (SEQ ID NO:174) and/or Chim_12 (SEQ ID NO:178) results in increase steviol+5Glc (#24) accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in increased steviol+5Glc (#25) accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in increased steviol+6Glc (isomer 1) accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in increased steviol+6Glc (#23) accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in increased steviol+7Glc (isomer 2) accumulation by a recombinant host. In some embodiments, expression of Chim_10 (SEQ ID NO:174) results in increased steviol+7Glc (isomer 5) accumulation by a recombinant host.

In some embodiments, expression of Chim_10 (SEQ ID NO:174), Chim_11 (SEQ ID NO:176), and/or Chim_12 (SEQ ID NO:178) results in decreased steviol-1,3-bioside accumulation by a recombinant host. In some embodiments, expression of Chim_10 (SEQ ID NO:174) results in decreased 1,2-stevioside accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in decreased 1,3-stevioside accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in decreased steviol+4Glc (#26) accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in decreased steviol+4Glc (#33) accumulation by a recombinant host. In some embodiments, expression of Chim_11 (SEQ ID NO:176) and/or Chim_13 (SEQ ID NO:180) results in decreased steviol+5Glc (#24) accumulation by a recombinant host. In some embodiments, expression of Chim_11 (SEQ ID NO:176), Chim_12 (SEQ ID NO:178), and/or Chim_13 (SEQ ID NO:180) results in decreased steviol+7Glc (isomer 5) accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in decreased 19-SMG accumulation by a recombinant host. In some embodiments, expression, of Chim_10 (SEQ ID NO:174), Chim_11 (SEQ ID NO:176), and/or Chim_12 (SEQ ID NO:178) results in decreased steviol-1,2-bioside accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in decreased rubusoside accumulation by a recombinant host. In some embodiments, expression of Chim_10 (SEQ ID NO:174), Chim_11 (SEQ ID NO:176), and/or Chim_12 (SEQ ID NO:178) results in decreased RebB accumulation by a recombinant host. In some embodiments, expression of Chim_10 (SEQ ID NO:174) results in decreased RebA accumulation by a recombinant host. In some embodiments, expression of Chim_11 (SEQ ID NO:176), Chim_12 (SEQ ID NO:178), and/or Chim_13 results in decreased RebE accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in decreased ent-kaurenoic acid+2Glc (#7) accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in decreased ent-kaurenoic acid+3Glc (isomer 1) accumulation by a recombinant host. In some embodiments, expression of Chim_10 (SEQ ID NO:174), Chim_11 (SEQ ID NO:176), Chim_12 (SEQ ID NO:178), and/or Chim_13 (SEQ ID NO:180) results in decreased ent-kaurenoic acid+3Glc (isomer 2) accumulation by a recombinant host.

In some embodiments, a recombinant host comprises a gene encoding a polypeptide capable of glycosylating steviol or a steviol glycoside at its C-19 carboxyl group. In certain such embodiments, the gene encoding a polypeptide capable of glycosylating steviol or a steviol glycoside at its C-19 carboxyl group is a UGT74G1 homolog (e.g., a UGT74G1 homolog having one or more amino acid substitutions corresponding to residues 18, 20, 21, 23, 68, 69, 70, 71, 72, 73, 74, 75, 76, 77, 78, 79, 80, 81, 82, 83, 85, 86, 119, 140, 148, 179, 184, 185, 191, 194, 195, 284, 285, 286, 375, 376, 377, 378 with respect to SEQ ID NO:4). In certain such embodiments the gene encoding a polypeptide capable of glycosylating steviol or a steviol glycoside at its C-19 carboxyl group is a UGT74G1 homolog having a substitution, with respect to SEQ ID NO:4, corresponding to residue 79 (e.g., a valine or a glutamic acid corresponding to residue 79). In certain such embodiments the gene encoding a polypeptide capable of glycosylating steviol or a steviol glycoside at its C-19 carboxyl group is a UGT74G1 homolog having a substitution, with respect to SEQ ID NO:4, corresponding to residue 80 (e.g., a cysteine corresponding to residue 80). In certain such embodiments the gene encoding a polypeptide capable of glycosylating steviol or a steviol glycoside at its C-19 carboxyl group is a UGT74G1 homolog having a substitution, with respect to SEQ ID NO:4, corresponding to residue 81 (e.g., a tryptophan corresponding to residue 81). In certain such embodiments the gene encoding a polypeptide capable of glycosylating steviol or a steviol glycoside at its C-19 carboxyl group is a UGT74G1 homolog having a substitution, with respect to SEQ ID NO:4, corresponding to residue 83 (e.g., a lysine corresponding to residue 83). In certain such embodiments the gene encoding a polypeptide capable of glycosylating steviol or a steviol glycoside at its C-19 carboxyl group is a UGT74G1 homolog having a substitution, with respect to SEQ ID NO:4, corresponding to residue 184 (e.g., a valine or a threonine corresponding to residue 184). In certain such embodiments the gene encoding a polypeptide capable of glycosylating steviol or a steviol glycoside at its C-19 carboxyl group is a UGT74G1 homolog having a substitution, with respect to SEQ ID NO:4, corresponding to residue 260 (e.g., a threonine corresponding to residue 260). In certain such embodiments the gene encoding a polypeptide capable of glycosylating steviol or a steviol glycoside at its C-19 carboxyl group is a UGT74G1 homolog having a substitution, with respect to SEQ ID NO:4, corresponding to residue 286 (e.g., a glutamic acid, a cysteine, an asparagine, or a threonine corresponding to residue 286). In certain such embodiments the gene encoding a polypeptide capable of glycosylating steviol or a steviol glycoside at its C-19 carboxyl group is a UGT74G1 homolog having a substitution, with respect to SEQ ID NO:4, corresponding to residue 377 (e.g., a glutamine corresponding to residue 377).

In some embodiments, a recombinant host comprises a gene encoding a polypeptide capable of glycosylating steviol or a steviol glycoside at its C-19 carboxyl group (e.g., a polypeptide having the amino acid sequence set forth in SEQ ID NO:118, SEQ ID NO:120, SEQ ID NO:122, SEQ ID NO:124, SEQ ID NO:126, SEQ ID NO:128, SEQ ID NO:130, SEQ ID NO:161, SEQ ID NO:163, SEQ ID NO:165, SEQ ID NO:167, or SEQ ID NO:169). In certain embodiments, a recombinant host cell comprising a gene encoding a polypeptide capable of glycosylating steviol or a steviol glycoside at its C-19 carboxyl group (e.g., a polypeptide having the amino acid sequence set forth in SEQ ID NO:118, SEQ ID NO:120, SEQ ID NO:122, SEQ ID NO:124, SEQ ID NO:126, SEQ ID NO:128, SEQ ID NO:130, SEQ ID NO:161, SEQ ID NO:163, SEQ ID NO:165, SEQ ID NO:167, or SEQ ID NO:169) further comprises a gene encoding a polypeptide capable of glycosylating steviol or a steviol glycoside at its C-13 hydroxyl group (e.g., a polypeptide having the amino acid sequence set forth in SEQ ID NO:7); a gene encoding a polypeptide capable of beta 1,3 glycosylation of the C3' of the 13-O-glucose, 19-O-glucose, or both 13-O-glucose and 19-O-glucose of a steviol glycoside (e.g., a polypeptide having the amino acid sequence set forth in SEQ ID NO:9); a gene encoding a polypeptide capable of glycosylating steviol or a steviol glycoside at its C-19 carboxyl group (e.g., a polypeptide having the amino acid sequence set forth in SEQ ID NO:4); and/or a gene encoding a polypeptide capable of beta 1,2 glycosylation of the C2' of the 13-O-glucose, 19-O-glucose, or both 13-O-glucose and 19-O-glucose of a steviol glycoside (e.g., a polypeptide having the amino acid sequence set forth in SEQ ID NO:11, SEQ ID NO:13, or SEQ ID NO:16). In certain such embodiments, the recombinant host cell further comprises a gene encoding a polypeptide capable of synthesizing GGPP from FPP and IPP (e.g., a polypeptide having the amino acid sequence set forth in SEQ ID NO:20); a gene encoding a polypeptide capable of synthesizing ent-copalyl diphosphate from GGPP (e.g., a polypeptide having the amino acid sequence set forth in SEQ ID NO:40); a gene encoding a polypeptide capable of synthesizing ent-kaurene from ent-copalyl diphosphate (e.g., a polypeptide having the amino acid sequence set forth in SEQ ID NO:52); a gene encoding a polypeptide capable of synthesizing ent-kaurenoic acid, ent-kaurenol, and/or ent-kaurenal from ent-kaurene (e.g., a polypeptide having the amino acid sequence set forth in SEQ ID NO:60 or SEQ ID NO:117); a gene encoding a polypeptide capable of reducing cytochrome P450 complex (e.g., a polypeptide having the amino acid sequence set forth in SEQ ID NO:78, SEQ ID NO:86, or SEQ ID NO:92); and/or a gene encoding a polypeptide capable of synthesizing steviol from ent-kaurenoic acid (e.g., a polypeptide having the amino acid sequence set forth in SEQ ID NO:94).

In some embodiments, a recombinant host comprises a gene encoding a bifunctional polypeptide capable of glycosylating steviol or a steviol glycoside at its C-19 carboxyl group and glycosylating steviol or a steviol glycoside at its C-13 hydroxyl group. In certain such embodiments, the polypeptide is a UGT74G1-b-UGT85C2 chimeric polypeptide (e.g., a polypeptide having the amino acid sequence set forth in SEQ ID NO:134, SEQ ID NO:136, SEQ ID NO:144, SEQ ID NO:146, or SEQ ID NO:148). In certain such embodiments, the polypeptide is a UGT85C2-b-UGT74G1 chimeric polypeptide (e.g., a polypeptide having the amino acid sequence set forth in SEQ ID NO:132, SEQ ID NO:138, SEQ ID NO:140, or SEQ ID NO:142).

In some embodiments, a recombinant host comprises a gene encoding a bifunctional polypeptide capable of glycosylating steviol or a steviol glycoside at its C-19 carboxyl group and glycosylating steviol or a steviol glycoside at its C-13 hydroxyl group (e.g., SEQ ID NO:132, SEQ ID NO:134, SEQ ID NO:136, SEQ ID NO:138, SEQ ID NO:140, SEQ ID NO:142, SEQ ID NO:144, SEQ ID NO:146, or SEQ ID NO:148). In some embodiments, a recombinant host comprising a gene encoding a bifunctional polypeptide capable of glycosylating steviol or a steviol glycoside at its C-19 carboxyl group and glycosylating steviol or a steviol glycoside at its C-13 hydroxyl group (e.g., SEQ ID NO:132, SEQ ID NO:134, SEQ ID NO:136, SEQ ID NO:138, SEQ ID NO:140, SEQ ID NO:142, SEQ ID NO:144, SEQ ID NO:146, or SEQ ID NO:148) further comprises a gene encoding a polypeptide capable of glycosylating steviol or a steviol glycoside at its C-13 hydroxyl group (e.g., a polypeptide having the amino acid sequence set forth in SEQ ID NO:7); a gene encoding a polypeptide capable of beta 1,3 glycosylation of the C3' of the 13-O-glucose, 19-O-glucose, or both 13-O-glucose and 19-O-glucose of a steviol glycoside (e.g., a polypeptide having the amino acid sequence set forth in SEQ ID NO:9); a gene encoding a polypeptide capable of glycosylating steviol or a steviol glycoside at its C-19 carboxyl group (e.g., a polypeptide having the amino acid sequence set forth in SEQ ID NO:4); and/or a gene encoding a polypeptide capable of beta 1,2 glycosylation of the C2' of the 13-O-glucose, 19-O-glucose, or both 13-O-glucose and 19-O-glucose of a steviol glycoside (e.g., a polypeptide having the amino acid sequence set forth in SEQ ID NO:11, SEQ ID NO:13, or SEQ ID NO:16). In certain such embodiments, the recombinant host cell further comprises a gene encoding a polypeptide capable of synthesizing GGPP from FPP and IPP (e.g., a polypeptide having the amino acid sequence set forth in SEQ ID NO:20); a gene encoding a polypeptide capable of synthesizing ent-copalyl diphosphate from GGPP (e.g., a polypeptide having the amino acid sequence set forth in SEQ ID NO:40); a gene encoding a polypeptide capable of synthesizing ent-kaurene from ent-copalyl diphosphate (e.g., a polypeptide having the amino acid sequence set forth in SEQ ID NO:52); a gene encoding a polypeptide capable of synthesizing ent-kaurenoic acid, ent-kaurenol, and/or ent-kaurenal from ent-kaurene (e.g., a polypeptide having the amino acid sequence set forth in SEQ ID NO:60 or SEQ ID NO:117); a gene encoding a polypeptide capable of reducing cytochrome P450 complex (e.g., a polypeptide having the amino acid sequence set forth in SEQ ID NO:78, SEQ ID NO:86, or SEQ ID NO:92); and/or a gene encoding a polypeptide capable of synthesizing steviol from ent-kaurenoic acid (e.g., a polypeptide having the amino acid sequence set forth in SEQ ID NO:94).

In some embodiments, a recombinant host comprises a gene encoding a tagged polypeptide comprising a polypeptide capable of glycosylating steviol or a steviol glycoside at its C-19 carboxyl group (e.g., a UGT74G1 homolog; e.g., a polypeptide having the amino acid sequence set forth in SEQ ID NO:4) and a tag (e.g., a tag having the amino acid sequence set forth in SEQ ID NO:152, SEQ ID NO:153, SEQ ID NO:154, or SEQ ID NO:155), joined through a linker (e.g., a linker having the amino acid sequence set forth in SEQ ID NO:151).

In some embodiments, a recombinant host comprises a gene encoding a tagged polypeptide capable of glycosylating steviol or a steviol glycoside at its C-19 carboxyl group (e.g., a polypeptide having the amino acid sequence set forth in SEQ ID NO:174, SEQ ID NO:176, SEQ ID NO:178, or SEQ ID NO:180). In some embodiments, a recombinant host comprising a gene encoding a tagged polypeptide capable of glycosylating steviol or a steviol glycoside at its C-19 carboxyl group (e.g., a polypeptide having the amino acid sequence set forth in SEQ ID NO:174, SEQ ID NO:176, SEQ ID NO:178, or SEQ ID NO:180) further comprises a gene encoding a polypeptide capable of glycosylating steviol or a steviol glycoside at its C-13 hydroxyl group (e.g., a polypeptide having the amino acid sequence set forth in SEQ ID NO:7); a gene encoding a polypeptide capable of beta 1,3 glycosylation of the C3' of the 13-O-glucose, 19-O-glucose, or both 13-O-glucose and 19-O-glucose of a steviol glycoside (e.g., a polypeptide having the amino acid sequence set forth in SEQ ID NO:9); a gene encoding a polypeptide capable of glycosylating steviol or a steviol glycoside at its C-19 carboxyl group (e.g., a polypeptide having the amino acid sequence set forth in SEQ ID NO:4); and/or a gene encoding a polypeptide capable of beta 1,2 glycosylation of the C2' of the 13-O-glucose, 19-O-glucose, or both 13-O-glucose and 19-O-glucose of a steviol glycoside (e.g., a polypeptide having the amino acid sequence set forth in SEQ ID NO:11, SEQ ID NO:13, or SEQ ID NO:16). In certain such embodiments, the recombinant host cell further comprises a gene encoding a polypeptide capable of synthesizing GGPP from FPP and IPP (e.g., a polypeptide having the amino acid sequence set forth in SEQ ID NO:20); a gene encoding a polypeptide capable of synthesizing ent-copalyl diphosphate from GGPP (e.g., a polypeptide having the amino acid sequence set forth in SEQ ID NO:40); a gene encoding a polypeptide capable of synthesizing ent-kaurene from ent-copalyl diphosphate (e.g., a polypeptide having the amino acid sequence set forth in SEQ ID NO:52); a gene encoding a polypeptide capable of synthesizing ent-kaurenoic acid, ent-kaurenol, and/or ent-kaurenal from ent-kaurene (e.g., a polypeptide having the amino acid sequence set forth in SEQ ID NO:60 or SEQ ID NO:117); a gene encoding a polypeptide capable of reducing cytochrome P450 complex (e.g., a polypeptide having the amino acid sequence set forth in SEQ ID NO:78, SEQ ID NO:86, or SEQ ID NO:92); and/or a gene encoding a polypeptide capable of synthesizing steviol from ent-kaurenoic acid (e.g., a polypeptide having the amino acid sequence set forth in SEQ ID NO:94).

In some embodiments, one or more steviol glycosides and/or glycosylated steviol precursors, or a composition thereof is produced by whole cell bioconversion. In some embodiments, the method for producing one or more steviol glycosides and/or glycosylated steviol precursors, or a composition thereof as disclosed herein comprises whole cell bioconversion of a plant-derived or synthetic steviol glycoside precursor or a plant-derived or synthetic steviol precursor in a cell culture medium of a recombinant host cell using (a) a polypeptide capable of glycosylating steviol or a steviol glycoside at its C-19 carboxyl group having at least 55% sequence identity to the amino acid sequence set forth in SEQ ID NO:4, and further having at least one amino acid substitution corresponding to residues 79, 80, 81, 83, 184, 260, 286, or 377 of SEQ ID NO:4; (b) a polypeptide capable of glycosylating steviol or a steviol glycoside at its C-19 carboxyl group having at least 55% sequence identity to the amino acid sequence set forth in SEQ ID NO:4, and further having at least one amino acid substitution corresponding to residues 68, 69, 70, 71, 72, 73, 74, 75, 76, 77, 78, 79, 80, 81, 82, or 83 of SEQ ID NO:4; (c) a bifunctional polypeptide capable of glycosylating steviol or a steviol glycoside at its C-19 carboxyl group and glycosylating steviol or a steviol glycoside at its C-13 hydroxyl group, having at least 50% sequence identity to the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148; and/or (d) a tagged polypeptide capable of glycosylating steviol or a steviol glycoside at its C-19 carboxyl group, having at least 55% sequence identity to the amino acid sequence set forth in SEQ ID NO:174, SEQ ID NO:176, SEQ ID NO:178, or SEQ ID NO:180; wherein at least one of the polypeptides is a recombinant polypeptide expressed in the recombinant host cell; and producing the one or more steviol glycosides and/or glycosylated steviol precursors, or a composition thereof, thereby.

In some embodiments, a steviol glycoside or steviol glycoside precursor composition produced in vivo, in vitro, or by whole cell bioconversion comprises fewer contaminants or less of any particular contaminant than a *stevia* extract from, inter alia, a *stevia* plant. Contaminants can include plant-derived compounds that contribute to off-flavors. Potential contaminants include pigments, lipids, proteins, phenolics, saccharides, spathulenol and other sesquiterpenes, labdane diterpenes, monoterpenes, decanoic acid, 8,11,14-eicosatrienoic acid, 2-methyloctadecane, pentacosane, octacosane, tetracosane, octadecanol, stigmasterol, P-sitosterol, a-amyrin, P-amyrin, lupeol, β-amyrin acetate, pentacyclic triterpenes, centauredin, quercitin, epi-alpha-cadinol, carophyllenes and derivatives, beta-pinene, beta-sitosterol, and gibberellin.

As used herein, the terms "detectable amount," "detectable concentration," "measurable amount," and "measurable concentration" refer to a level of steviol glycosides measured in AUC, $\mu M/OD_{600}$, mg/L, $\mu M$, or mM. Steviol glycoside production (i.e., total, supernatant, and/or intracellular steviol glycoside levels) can be detected and/or analyzed by techniques generally available to one skilled in the art, for example, but not limited to, liquid chromatography-mass spectrometry (LC-MS), thin layer chromatography (TLC), high-performance liquid chromatography (HPLC), ultraviolet-visible spectroscopy/spectrophotometry (UV-Vis), mass spectrometry (MS), and NMR.

As used herein, the term "undetectable concentration" refers to a level of a compound that is too low to be measured and/or analyzed by techniques such as TLC, HPLC, UV-Vis, MS, or NMR. In some embodiments, a compound of an "undetectable concentration" is not present in a steviol glycoside or steviol glycoside precursor composition.

As used herein, the terms "or" and "and/or" is utilized to describe multiple components in combination or exclusive of one another. For example, "x, y, and/or z" can refer to "x" alone, "y" alone, "z" alone, "x, y, and z," "(x and y) or z," "x or (y and z)," or "x or y or z." In some embodiments, "and/or" is used to refer to the exogenous nucleic acids that a recombinant cell comprises, wherein a recombinant cell comprises one or more exogenous nucleic acids selected from a group. In some embodiments, "and/or" is used to refer to production of steviol glycosides and/or steviol glycoside precursors. In some embodiments, "and/or" is used to refer to production of steviol glycosides, wherein one or more steviol glycosides are produced. In some embodiments, "and/or" is used to refer to production of steviol glycosides, wherein one or more steviol glycosides are produced through one or more of the following steps: culturing a recombinant microorganism, synthesizing one or more steviol glycosides in a recombinant microorganism, and/or isolating one or more steviol glycosides.

Functional Homologs

Functional homologs of the polypeptides described above are also suitable for use in producing steviol glycosides in a recombinant host. A functional homolog is a polypeptide that has sequence similarity to a reference polypeptide, and that carries out one or more of the biochemical or physiological function(s) of the reference polypeptide. A functional homolog and the reference polypeptide can be a natural occurring polypeptide, and the sequence similarity can be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, can themselves be functional homologs. Functional homologs can also be created via site-directed mutagenesis of the coding sequence for a polypeptide, or by combining domains from the coding sequences for different naturally-occurring polypeptides ("domain swapping"). Techniques for modifying genes encoding functional polypeptides described herein are known and include, inter alia, directed evolution techniques, site-directed mutagenesis techniques and random mutagenesis techniques, and can be useful to increase specific activity of a polypeptide, alter substrate specificity, alter expression levels, alter subcellular location, or modify polypeptide-polypeptide interactions in a desired manner. Such modified polypeptides are considered functional homologs. The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of steviol glycoside biosynthesis polypeptides. Sequence analysis can involve BLAST, Reciprocal BLAST, or PSI-BLAST analysis of non-redundant databases using a UGT amino acid sequence as the reference sequence. Amino acid sequence is, in some instances, deduced from the nucleotide sequence. Those polypeptides in the database that have greater than 40% sequence identity are candidates for further evaluation for suitability as a steviol glycoside biosynthesis polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in steviol glycoside biosynthesis polypeptides, e.g., conserved functional domains. In some embodiments, nucleic acids and polypeptides are identified from transcriptome data based on expression levels rather than by using BLAST analysis.

Conserved regions can be identified by locating a region within the primary amino acid sequence of a steviol glycoside biosynthesis polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. The information included at the Pfam database is described in Sonnhammer et al., *Nucl. Acids Res.*, 26:320-322 (1998); Sonnhammer et al., Proteins, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate to identify such homologs.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

For example, polypeptides suitable for producing steviol in a recombinant host include functional homologs of UGTs.

Methods to modify the substrate specificity of, for example, a UGT, are known to those skilled in the art, and include without limitation site-directed/rational mutagenesis approaches, random directed evolution approaches and combinations in which random mutagenesis/saturation techniques are performed near the active site of the enzyme. For example see Osmani et al., 2009, *Phytochemistry* 70: 325-347.

A candidate sequence typically has a length that is from 80% to 250% of the length of the reference sequence, e.g., 82, 85, 87, 89, 90, 93, 95, 97, 99, 100, 105, 110, 115, 120, 130, 140, 150, 160, 170, 180, 190, 200, 210, 220, 230, 240, or 250% of the length of the reference sequence. A functional homolog polypeptide typically has a length that is from 95% to 105% of the length of the reference sequence, e.g., 90, 93, 95, 97, 99, 100, 105, 110, 115, or 120% of the length of the reference sequence, or any range between. A % identity for any candidate nucleic acid or polypeptide relative to a reference nucleic acid or polypeptide can be determined as follows. A reference sequence (e.g., a nucleic acid sequence or an amino acid sequence described herein) is aligned to one or more candidate sequences using the computer program Clustal Omega (version 1.2.1, default parameters), which allows alignments of nucleic acid or polypeptide sequences to be carried out across their entire length (global alignment). Chenna et al., 2003, *Nucleic Acids Res.* 31(13):3497-500.

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: % age; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: % age; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine a % identity of a candidate nucleic acid or amino acid sequence to a reference sequence, the sequences are aligned using Clustal Omega, the number of identical matches in the alignment is divided by the length of the reference sequence, and the result is multiplied by 100. It is noted that the % identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

It will be appreciated that functional UGT (e.g., a polypeptide capable of glycosylating steviol or a steviol glycoside at its C-13 hydroxyl group; a polypeptide capable of beta 1,3 glycosylation of the C3' of the 13-O-glucose, 19-O-glucose, or both 13-O-glucose and 19-O-glucose of a steviol glycoside; a polypeptide capable of glycosylating steviol or a steviol glycoside at its C-19 carboxyl group; and/or a polypeptide capable of beta 1,2 glycosylation of the C2' of the 13-O-glucose, 19-O-glucose, or both 13-O-glucose and 19-O-glucose of a steviol glycoside) proteins can include additional amino acids that are not involved in the enzymatic activities carried out by the enzymes. In some embodiments, UGT proteins are fusion proteins. The terms "chimera," "fusion polypeptide," "fusion protein," "fusion enzyme," "fusion construct," "chimeric protein," "chimeric polypeptide," "chimeric construct," and "chimeric enzyme" can be used interchangeably herein to refer to proteins engineered through the joining of two or more genes that code for different proteins.

In some embodiments, a chimeric enzyme is constructed by joining the C-terminal of a first polypeptide ProteinA to the N-terminal of a second polypeptide ProteinB through a linker "b," i.e., "ProteinA-b-ProteinB." In some aspects, the linker of a chimeric enzyme may be the amino acid sequence "KLVK" (SEQ ID NO:191). In some aspects, the linker of a chimeric enzyme may be the amino acid sequence "RASSTKLVK" (SEQ ID NO:150) In some aspects, the linker of a chimeric enzyme may be the amino acid sequence "GGGGS" (SEQ ID NO:192). In some aspects, the linker of a chimeric enzyme may be two repeats of the amino acid sequence "GGGGS" (SEQ ID NO:192) (i.e., "GGGGSGGGGS" (SEQ ID NO:193)). In some aspects, the linker of a chimeric enzyme may be three repeats of the amino acid sequence "GGGGS" (SEQ ID NO:192). In some aspects, the linker of a chimeric enzyme maybe the amino acid sequence "EGKSSGSGSESKST" (SEQ ID NO:151). In some aspects, the linker of a chimeric enzyme is a direct bond between the C-terminal of a first polypeptide and the N-terminal of a second polypeptide. In some embodiments, a chimeric enzyme is constructed by joining the C-terminal of a first polypeptide ProteinA to the N-terminal of a second polypeptide ProteinB through a linker "b," i.e., "ProteinA-b-ProteinB" and by joining the C-terminal of the second polypeptide ProteinB to the N-terminal of a third polypeptide ProteinC through a second linker "d," i.e., "ProteinA-b-ProteinB-d-ProteinC.

In some embodiments, a nucleic acid sequence encoding a UGT polypeptide (e.g., a polypeptide capable of glycosylating steviol or a steviol glycoside at its C-13 hydroxyl group; a polypeptide capable of beta 1,3 glycosylation of the C3' of the 13-O-glucose, 19-O-glucose, or both 13-O-glucose and 19-O-glucose of a steviol glycoside; a polypeptide capable of glycosylating steviol or a steviol glycoside at its C-19 carboxyl group; and/or a polypeptide capable of beta 1,2 glycosylation of the C2' of the 13-O-glucose, 19-O-glucose, or both 13-O-glucose and 19-O-glucose of a steviol glycoside) can include a tag sequence that encodes a "tag" designed to facilitate subsequent manipulation (e.g., to facilitate purification or detection), solubility, secretion, or localization of the encoded polypeptide. Tag sequences can be inserted in the nucleic acid sequence encoding the polypeptide such that the encoded tag is located at either the carboxyl (i.e., C-terminal) or amino terminus (i.e., N-terminal) of the polypeptide. Non-limiting examples of encoded tags include green fluorescent protein (GFP), human influenza hemagglutinin (HA), glutathione S transferase (GST), polyhistidine-tag (HIS tag), disulfide oxiodoreductase (DsbA) (e.g., SEQ ID NO:156), maltose binding protein (MBP) (e.g., SEQ ID NO:157), N-utilization substance (NusA) (e.g., SEQ ID NO:158), and small ubiquitin-like modifier (SUMO) (e.g., SEQ ID NO:159). Other examples of tags include a chloroplast transit peptide, a mitochondrial transit peptide, an amyloplast peptide, signal peptide, or a secretion tag. In some embodiments, a tag is attached to a polypeptide capable of glycosylating steviol or a steviol glycoside at its C-19 carboxyl group. In some embodiments, the tag is attached to a polypeptide capable of glycosylating steviol or a steviol glycoside at its C-19 carboxyl group using a linker of SEQ ID NO:151. See Examples 5 and 7-9.

In some embodiments, a fusion protein is a protein altered by domain swapping. As used herein, the term "domain swapping" is used to describe the process of replacing a domain of a first protein with a domain of a second protein.

In some embodiments, the domain of the first protein and the domain of the second protein are functionally identical or functionally similar. In some embodiments, the structure and/or sequence of the domain of the second protein differs from the structure and/or sequence of the domain of the first protein. In some embodiments, a UGT polypeptide is altered by domain swapping.

In some embodiments, a fusion protein is a protein altered by circular permutation, which consists in the covalent attachment of the ends of a protein that would be opened elsewhere afterwards. Thus, the order of the sequence is altered without causing changes in the amino acids of the protein. In some embodiments, a targeted circular permutation can be produced, for example but not limited to, by designing a spacer to join the ends of the original protein. Once the spacer has been defined, there are several possibilities to generate permutations through generally accepted molecular biology techniques, for example but not limited to, by producing concatemers by means of PCR and subsequent amplification of specific permutations inside the concatemer or by amplifying discrete fragments of the protein to exchange to join them in a different order. The step of generating permutations can be followed by creating a circular gene by binding the fragment ends and cutting back at random, thus forming collections of permutations from a unique construct. In some embodiments, DAP1 polypeptide is altered by circular permutation.

Steviol and Steviol Glycoside Biosynthesis Nucleic Acids

A recombinant gene encoding a polypeptide described herein comprises the coding sequence for that polypeptide, operably linked in sense orientation to one or more regulatory regions suitable for expressing the polypeptide. Because many microorganisms are capable of expressing multiple gene products from a polycistronic mRNA, multiple polypeptides can be expressed under the control of a single regulatory region for those microorganisms, if desired. A coding sequence and a regulatory region are considered to be operably linked when the regulatory region and coding sequence are positioned so that the regulatory region is effective for regulating transcription or translation of the sequence. Typically, the translation initiation site of the translational reading frame of the coding sequence is positioned between one and about fifty nucleotides downstream of the regulatory region for a monocistronic gene.

In many cases, the coding sequence for a polypeptide described herein is identified in a species other than the recombinant host, i.e., is a heterologous nucleic acid. Thus, if the recombinant host is a microorganism, the coding sequence can be from other prokaryotic or eukaryotic microorganisms, from plants or from animals. In some case, however, the coding sequence is a sequence that is native to the host and is being reintroduced into that organism. A native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. "Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). A regulatory region is operably linked to a coding sequence by positioning the regulatory region and the coding sequence so that the regulatory region is effective for regulating transcription or translation of the sequence. For example, to operably link a coding sequence and a promoter sequence, the translation initiation site of the translational reading frame of the coding sequence is typically positioned between one and about fifty nucleotides downstream of the promoter. A regulatory region can, however, be positioned as much as about 5,000 nucleotides upstream of the translation initiation site, or about 2,000 nucleotides upstream of the transcription start site.

The choice of regulatory regions to be included depends upon several factors, including, but not limited to, efficiency, selectability, inducibility, desired expression level, and preferential expression during certain culture stages. It is a routine matter for one of skill in the art to modulate the expression of a coding sequence by appropriately selecting and positioning regulatory regions relative to the coding sequence. It will be understood that more than one regulatory region may be present, e.g., introns, enhancers, upstream activation regions, transcription terminators, and inducible elements.

One or more genes can be combined in a recombinant nucleic acid construct in "modules" useful for a discrete aspect of steviol and/or steviol glycoside production. Combining a plurality of genes in a module, particularly a polycistronic module, facilitates the use of the module in a variety of species. For example, a steviol biosynthesis gene cluster, or a UGT gene cluster, can be combined in a polycistronic module such that, after insertion of a suitable regulatory region, the module can be introduced into a wide variety of species. As another example, a UGT gene cluster can be combined such that each UGT coding sequence is operably linked to a separate regulatory region, to form a UGT module. Such a module can be used in those species for which monocistronic expression is necessary or desirable. In addition to genes useful for steviol or steviol glycoside production, a recombinant construct typically also contains an origin of replication, and one or more selectable markers for maintenance of the construct in appropriate species.

It will be appreciated that because of the degeneracy of the genetic code, a number of nucleic acids can encode a particular polypeptide; i.e., for many amino acids, there is more than one nucleotide triplet that serves as the codon for the amino acid. Thus, codons in the coding sequence for a given polypeptide can be modified such that optimal expression in a particular host is obtained, using appropriate codon bias tables for that host (e.g., microorganism). As isolated nucleic acids, these modified sequences can exist as purified molecules and can be incorporated into a vector or a virus for use in constructing modules for recombinant nucleic acid constructs.

In some cases, it is desirable to inhibit one or more functions of an endogenous polypeptide in order to divert metabolic intermediates towards steviol or steviol glycoside biosynthesis. For example, it may be desirable to downregulate synthesis of sterols in a yeast strain in order to further increase steviol or steviol glycoside production, e.g., by downregulating squalene epoxidase. As another example, it may be desirable to inhibit degradative functions of certain endogenous gene products, e.g., glycohydrolases that remove glucose moieties from secondary metabolites or phosphatases as discussed herein. In such cases, a nucleic acid that overexpresses the polypeptide or gene product may be included in a recombinant construct that is transformed into the strain. Alternatively, mutagenesis can be used to generate mutants in genes for which it is desired to increase or enhance function.

One aspect of the disclosure is a nucleic acid molecule encoding a polypeptide capable of glycosylating steviol or a steviol glycoside at its C-19 carboxyl group or a catalytically active portion thereof. In one aspect, the nucleic acid is an isolated nucleic acid. In one aspect, the nucleic acid is cDNA. In some embodiments, the encoded polypeptide capable of glycosylating steviol or a steviol glycoside at its C-19 carboxyl group or the catalytically active portion thereof comprises a polypeptide having the amino acid sequence set forth in SEQ ID NO:4, and further having at least one amino acid substitution corresponding to residues 79, 80, 81, 83, 184, 260, 286, or 377 of SEQ ID NO:4. In some embodiments, the encoded polypeptide capable of glycosylating steviol or a steviol glycoside at its C-19 carboxyl group or the catalytically active portion thereof comprises a polypeptide having the amino acid sequence set forth in SEQ ID NO:4, and further having at least one amino acid substitution corresponding to residues 68, 69, 70, 71, 72, 73, 74, 75, 76, 77, 78, 79, 80, 81, 82, or 83 of SEQ ID NO:4. In some embodiments, the encoded polypeptide capable of glycosylating steviol or a steviol glycoside at its C-19 carboxyl group or the catalytically active portion thereof comprises a polypeptide having the amino acid sequence set forth in SEQ ID NO:4, and further having a M79V, M79E, S80C, A81W, E83K, H184V, H184T N260T, K286C, K286E, K286N, K286T, and/or S377Q substitution corresponding to SEQ ID NO:4. In some embodiments, the encoded polypeptide capable of glycosylating steviol or a steviol glycoside at its C-19 carboxyl group or the catalytically active portion thereof comprises a polypeptide having the amino acid sequence set forth in SEQ ID NO:4, and further having a K286C substitution corresponding to SEQ ID NO:4 (i.e., SEQ ID NO:118); a M79V substitution corresponding to SEQ ID NO:4 (i.e., SEQ ID NO:120); a S377Q substitution corresponding to SEQ ID NO:4 (i.e., SEQ ID NO:122); a S80C substitution corresponding to SEQ ID NO:4 (i.e., SEQ ID NO:124); a N260T and a K286C substitution corresponding to SEQ ID NO:4 (i.e., SEQ ID NO:126); a H184V substitution corresponding to SEQ ID NO:4 (i.e., SEQ ID NO:128); a A81W and a E83K substitution corresponding to SEQ ID NO:4 (i.e., SEQ ID NO:130); a A81W substitution corresponding to SEQ ID NO:4 (i.e., SEQ ID NO:161); a H184T substitution corresponding to SEQ ID NO:4 (i.e., SEQ ID NO:163); a K286N substitution corresponding to SEQ ID NO:4 (i.e., SEQ ID NO:165); a M79E substitution corresponding to SEQ ID NO:4 (i.e., SEQ ID NO:167); or a K286T substitution corresponding to SEQ ID NO:4 (i.e., SEQ ID NO:169). In some embodiments, the encoded polypeptide capable of glycosylating steviol or a steviol glycoside at its C-19 carboxyl group or the catalytically active portion thereof further comprises a tag, e.g., a tag having the amino acid sequence set forth in SEQ ID NO:152, SEQ ID NO:153, SEQ ID NO:154, or SEQ ID NO:155.

Another aspect of the disclosure is a nucleic acid molecule encoding a tagged polypeptide capable of glycosylating steviol or a steviol glycoside at its C-19 carboxyl group or a catalytically active portion thereof. In one aspect, the nucleic acid is an isolated nucleic acid. In one aspect, the nucleic acid is cDNA. In some embodiments, the encoded tagged polypeptide capable of glycosylating steviol or a steviol glycoside at its C-19 carboxyl group or the catalytically active portion thereof comprises a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4) and a tag (e.g., a tag having the amino acid sequence set forth in SEQ ID NO:152, SEQ ID NO:153, SEQ ID NO:154, or SEQ ID NO:155), joined through a linker. In some embodiments, the linker maybe the amino acid sequence "KLVK" (SEQ ID NO:191). In some embodiments, the linker may the amino acid sequence "EGKSSGSGSESKST" (SEQ ID NO:151). In some embodiments, the linker is the amino acid sequence RASST-KLVK" (SEQ ID NO:150). In some embodiments, the linker is the amino acid sequence "GGGGS" (SEQ ID NO:192). In some embodiments, the linker is two repeates of the amino acid sequence "GGGGS" (SEQ ID NO:192) (i.e., "GGGGSGGGGS" (SEQ ID NO:193)). In some embodiments, the linker is three repeats of the amino acid sequence "GGGGS" (SEQ ID NO:192). In some embodiments, the linker is a direct bond (i.e., between the C-terminal of a first polypeptide and the N-terminal of a second polypeptide). In some embodiments, the encoded tagged polypeptide capable of glycosylating steviol or a steviol glycoside at its C-19 carboxyl group or the catalytically active portion thereof comprises a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4) joined at its N-terminal to the C-terminal of a tag (e.g., a tag having the amino acid sequence set forth in SEQ ID NO:152, SEQ ID NO:153, SEQ ID NO:154, or SEQ ID NO:155). In some embodiments, the encoded tagged polypeptide capable of glycosylating steviol or a steviol glycoside at its C-19 carboxyl group or the catalytically active portion thereof comprises a polypeptide having the amino acid sequence set forth in SEQ ID NO: 174, SEQ ID NO:176, SEQ ID NO:178, or SEQ ID NO:180.

Another aspect of the disclosure is a nucleic acid molecule encoding a bifunctional polypeptide capable of glycosylating steviol or a steviol glycoside at its C-19 carboxyl group and glycosylating steviol or a steviol glycoside at its C-13 hydroxyl group or a catalytically active portion thereof. In one aspect, the nucleic acid is an isolated nucleic acid. In one aspect, the nucleic acid is cDNA. In some embodiments, the encoded bifunctional polypeptide capable of glycosylating steviol or a steviol glycoside at its C-19 carboxyl group and glycosylating steviol or a steviol glycoside at its C-13 hydroxyl group or the catalytically active portion thereof comprises a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4) and a polypeptide capable of glycosylating steviol or a steviol glycoside at its C-13 hydroxyl group (e.g., a UGT85C2 polypeptide, e.g., a polypeptide having the amino acid sequence set forth in SEQ ID NO:7) joined through a linker. In some embodiments, the linker may be the amino acid sequence "KLVK" (SEQ ID NO:191). In some embodiments, the linker may the amino acid sequence "EGKSSGSGSESKST" (SEQ ID NO:151). In some embodiments, the linker is the amino acid sequence RASST-KLVK" (SEQ ID NO:150). In some embodiments, the linker is the amino acid sequence "GGGGS" (SEQ ID NO:192). In some embodiments, the linker is two repeates of the amino acid sequence "GGGGS" (SEQ ID NO:192) (i.e., "GGGGSGGGGS" (SEQ ID NO:193)). In some embodiments, the linker is three repeats of the amino acid sequence "GGGGS" (SEQ ID NO:192). In some embodiments, the linker is a direct bond (i.e., between the C-terminal of a first polypeptide and the N-terminal of a second polypeptide). In some embodiments, the encoded bifunctional polypeptide capable of glycosylating steviol or a steviol glycoside at its C-19 carboxyl group and glycosylating steviol or a steviol glycoside at its C-13 hydroxyl group or the catalytically active portion thereof comprises a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4), joined at its C-terminal to the N-terminal of a polypeptide capable of glycosylating steviol or a steviol glycoside at its C-13 hydroxyl group (e.g., a UGT85C2 polypeptide, e.g., a polypeptide having the amino acid sequence set forth in SEQ ID NO:7). In some embodiments, the encoded bifunctional polypeptide capable of glycosylating steviol or a steviol glycoside at its C-19 carboxyl group and glycosylating steviol or a steviol glycoside at its C-13 hydroxyl group or the catalytically active portion thereof comprises a polypeptide capable of glycosylating steviol or a steviol glycoside at its C-13 hydroxyl group (e.g., a UGT85C2 polypeptide, e.g., a polypeptide having the amino acid sequence set forth in SEQ ID NO:7), joined at its C-terminal to the N-terminal of a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4). In some embodiments, the encoded bifunctional polypeptide capable of glycosylating steviol or a steviol glycoside at its C-19 carboxyl group and glycosylating steviol or a steviol glycoside at its C-13 hydroxyl group or the catalytically active portion thereof comprises a polypeptide having the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148. In some embodiments, the encoded bifunctional polypeptide capable of glycosylating steviol or a steviol glycoside at its C-19 carboxyl group and glycosylating steviol or a steviol glycoside at its C-13 hydroxyl group or the catalytically active portion thereof further comprises a tag, e.g., a tag having the amino acid sequence set forth in SEQ ID NO:152, SEQ ID NO:153, SEQ ID NO:154, or SEQ ID NO:155.

One aspect of the disclosure is a polypeptide capable of glycosylating steviol or a steviol glycoside at its C-19 carboxyl group or a catalytically active portion thereof. In one aspect, the polypeptide is a purified polypeptide. In some embodiments, the polypeptide capable of glycosylating steviol or a steviol glycoside at its C-19 carboxyl group or the catalytically active portion thereof comprises a polypeptide having the amino acid sequence set forth in SEQ ID NO:4, and further having at least one amino acid substitution corresponding to residues 79, 80, 81, 83, 184, 260, 286, or 377 of SEQ ID NO:4. In some embodiments, the polypeptide capable of glycosylating steviol or a steviol glycoside at its C-19 carboxyl group or the catalytically active portion thereof comprises a polypeptide having the amino acid sequence set forth in SEQ ID NO:4, and further having at least one amino acid substitution corresponding to residues 68, 69, 70, 71, 72, 73, 74, 75, 76, 77, 78, 79, 80, 81, 82, or 83 of SEQ ID NO:4. In some embodiments, the polypeptide capable of glycosylating steviol or a steviol glycoside at its C-19 carboxyl group or the catalytically active portion thereof comprises a polypeptide having the amino acid sequence set forth in SEQ ID NO:4, and further having a M79V, M79E, S80C, A81W, E83K, H184V, H184T N260T, K286C, K286E, K286N, K286T, and/or S377Q substitution corresponding to SEQ ID NO:4. In some embodiments, the polypeptide capable of glycosylating steviol or a steviol glycoside at its C-19 carboxyl group or the catalytically active portion thereof comprises a polypeptide having the amino acid sequence set forth in SEQ ID NO:4, and further having a K286C substitution corresponding to SEQ ID NO:4 (i.e., SEQ ID NO:118); a M79V substitution corresponding to SEQ ID NO:4 (i.e., SEQ ID NO:120); a S377Q substitution corresponding to SEQ ID NO:4 (i.e., SEQ ID NO:122); a S80C substitution corresponding to SEQ ID NO:4 (i.e., SEQ ID NO:124); a N260T and a K286C substitution corresponding to SEQ ID NO:4 (i.e., SEQ ID NO:126); a H184V substitution corresponding to SEQ ID NO:4 (i.e., SEQ ID NO:128); a A81W and a E83K substitution corresponding to SEQ ID NO:4 (i.e., SEQ ID NO:130); a A81W substitution corresponding to SEQ ID NO:4 (i.e., SEQ ID NO:161); a H184T substitution corresponding to SEQ ID NO:4 (i.e., SEQ ID NO:163); a K286N substitution corresponding to SEQ ID NO:4 (i.e., SEQ ID NO:165); a M79E substitution corresponding to SEQ ID NO:4 (i.e., SEQ ID NO:167); or a K286T substitution corresponding to SEQ ID NO:4 (i.e., SEQ ID NO:169). In some embodiments, the polypeptide capable of glycosylating steviol or a steviol glycoside at its C-19 carboxyl group or the catalytically active portion thereof further comprises a tag, e.g., a tag having the amino acid sequence set forth in SEQ ID NO:152, SEQ ID NO:153, SEQ ID NO:154, or SEQ ID NO:155.

Another aspect of the disclosure is a tagged polypeptide capable of glycosylating steviol or a steviol glycoside at its C-19 carboxyl group or a catalytically active portion thereof. In one aspect, the polypeptide is a purified polypeptide. In some embodiments, the tagged polypeptide capable of glycosylating steviol or a steviol glycoside at its C-19 carboxyl group or the catalytically active portion thereof comprises a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4) and a tag (e.g., a tag having the amino acid sequence set forth in SEQ ID NO:152, SEQ ID NO:153, SEQ ID NO:154, or SEQ ID NO:155), joined through a linker. In some embodiments, the linker may be the amino acid sequence "KLVK" (SEQ ID NO:191). In some embodiments, the linker may the amino acid sequence "EGKSSGSGSESKST" (SEQ ID NO:151). In some embodiments, the linker is the amino acid sequence RASSTKLVK" (SEQ ID NO:150). In some embodiments, the linker is the amino acid sequence "GGGGS" (SEQ ID NO:192). In some embodiments, the linker is two repeates of the amino acid sequence "GGGGS" (SEQ ID NO:192) (i.e., "GGGGSGGGGS" (SEQ ID NO:193)). In some embodiments, the linker is three repeats of the amino acid sequence "GGGGS" (SEQ ID NO:192). In some embodiments, the linker is a direct bond (i.e., between the C-terminal of a first polypeptide and the N-terminal of a second polypeptide). In some embodiments, the tagged polypeptide capable of glycosylating steviol or a steviol glycoside at its C-19 carboxyl group or the catalytically active portion thereof comprises a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4) joined at its N-terminal to the C-terminal of a tag (e.g., a tag having the amino acid sequence set forth in SEQ ID NO:152, SEQ ID NO:153, SEQ ID NO:154, or SEQ ID NO:155). In some embodiments, the tagged polypeptide capable of glycosylating steviol or a steviol glycoside at its C-19 carboxyl group or the catalytically active portion thereof comprises a polypeptide having the amino acid sequence set forth in SEQ ID NO: 174, SEQ ID NO:176, SEQ ID NO:178, or SEQ ID NO:180.

Another aspect of the disclosure is a bifunctional polypeptide capable of glycosylating steviol or a steviol glycoside at its C-19 carboxyl group and glycosylating steviol or a steviol glycoside at its C-13 hydroxyl group or a catalytically active portion thereof. In one aspect, the polypeptide is a purified polypeptide. In some embodiments, the bifunctional polypeptide capable of glycosylating steviol or a steviol glycoside at its C-19 carboxyl group and glycosylating steviol or a steviol glycoside at its C-13 hydroxyl group or the catalytically active portion thereof comprises a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4) and a polypeptide capable of glycosylating steviol or a steviol glycoside at its C-13 hydroxyl group (e.g., a UGT85C2 polypeptide, e.g., a polypeptide having the amino acid sequence set forth in SEQ ID NO:7) joined through a linker. In some embodiments, the linker may be the amino acid sequence "KLVK" (SEQ ID NO:191). In some embodiments, the linker may the amino acid sequence "EGKSSGSGSESKST" (SEQ ID NO:151). In some embodiments, the linker is the amino acid sequence RASSTKLVK" (SEQ ID NO:150). In some embodiments, the linker is the amino acid sequence "GGGGS" (SEQ ID NO:192). In some embodiments, the linker is two repeates of the amino acid sequence "GGGGS" (SEQ ID NO:192) (i.e., "GGGGSGGGGS" (SEQ ID NO:193)). In some embodiments, the linker is three repeats of the amino acid sequence "GGGGS" (SEQ ID NO:192). In some embodiments, the linker is a direct bond (i.e., between the C-terminal of a first polypeptide and the N-terminal of a second polypeptide). In some embodiments, the bifunctional polypeptide capable of glycosylating steviol or a steviol glycoside at its C-19 carboxyl group and glycosylating steviol or a steviol glycoside at its C-13 hydroxyl group or the catalytically active portion thereof comprises a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4), joined at its C-terminal to the N-terminal of a polypeptide capable of glycosylating steviol or a steviol glycoside at its C-13 hydroxyl group (e.g., a UGT85C2 polypeptide, e.g., a polypeptide having the amino acid sequence set forth in SEQ ID NO:7). In some embodiments, the bifunctional polypeptide capable of glycosylating steviol or a steviol glycoside at its C-19 carboxyl group and glycosylating steviol or a steviol glycoside at its C-13 hydroxyl group or the catalytically active portion thereof comprises a polypeptide capable of glycosylating steviol or a steviol glycoside at its C-13 hydroxyl group (e.g., a UGT85C2 polypeptide, e.g., a polypeptide having the amino acid sequence set forth in SEQ ID NO:7), joined at its C-terminal to the N-terminal of a polypeptide capable of glycosylating steviol or a steviol glycoside at its C-19 carboxyl group (e.g., a UGT74G1 polypeptide, e.g., a polypeptide having the amino acid sequence set forth in SEQ ID NO:4). In some embodiments, the bifunctional polypeptide capable of glycosylating steviol or a steviol glycoside at its C-19 carboxyl group and glycosylating steviol or a steviol glycoside at its C-13 hydroxyl group or the catalytically active portion thereof comprises a polypeptide having the amino acid sequence set forth in SEQ ID NO:132, SEQ ID NO:134, SEQ ID NO:136, SEQ ID NO:138, SEQ ID NO:140, or SEQ ID NO:142, SEQ ID NO:144, SEQ ID NO:146, or SEQ ID NO:148. In some embodiments, the bifunctional polypeptide capable of glycosylating steviol or a steviol glycoside at its C-19 carboxyl group and glycosylating steviol or a steviol glycoside at its C-13 hydroxyl group or the catalytically active portion thereof further comprises a tag, e.g., a tag having the amino acid sequence set forth in SEQ ID NO:152, SEQ ID NO:153, SEQ ID NO:154, or SEQ ID NO:155.

Host Microorganisms

Recombinant hosts can be used to express polypeptides for the producing steviol glycosides, including mammalian, insect, plant, and algal cells. A number of prokaryotes and eukaryotes are also suitable for use in constructing the recombinant microorganisms described herein, e.g., gram-negative bacteria, yeast, and fungi. A species and strain selected for use as a steviol glycoside production strain is first analyzed to determine which production genes are endogenous to the strain and which genes are not present. Genes for which an endogenous counterpart is not present in the strain are advantageously assembled in one or more recombinant constructs, which are then transformed into the strain in order to supply the missing function(s).

Typically, the recombinant microorganism is grown in a fermenter at a temperature(s) for a period of time, wherein the temperature and period of time facilitate production of a steviol glycoside. The constructed and genetically engineered microorganisms provided by the invention can be cultivated using conventional fermentation processes, including, inter alia, chemostat, batch, fed-batch cultivations, semi-continuous fermentations such as draw and fill, continuous perfusion fermentation, and continuous perfusion cell culture. Depending on the particular microorganism used in the method, other recombinant genes such as isopentenyl biosynthesis genes and terpene synthase and cyclase genes may also be present and expressed. Levels of substrates and intermediates, e.g., isopentenyl diphosphate, dimethylallyl diphosphate, GGPP, ent-Kaurene and ent-kaurenoic acid, can be determined by extracting samples from culture media for analysis according to published methods.

Carbon sources of use in the instant method include any molecule that can be metabolized by the recombinant host cell to facilitate growth and/or production of the steviol glycosides. Examples of suitable carbon sources include, but are not limited to, sucrose (e.g., as found in molasses), fructose, xylose, ethanol, glycerol, glucose, cellulose, starch, cellobiose or other glucose-comprising polymer. In embodiments employing yeast as a host, for example, carbons sources such as sucrose, fructose, xylose, ethanol, glycerol, and glucose are suitable. The carbon source can be provided to the host organism throughout the cultivation period or alternatively, the organism can be grown for a period of time in the presence of another energy source, e.g., protein, and then provided with a source of carbon only during the fed-batch phase.

After the recombinant microorganism has been grown in culture for the period of time, wherein the temperature and period of time facilitate production of a steviol glycoside, steviol and/or one or more steviol glycosides can then be recovered from the culture using various techniques known in the art. In some embodiments, a permeabilizing agent can be added to aid the feedstock entering into the host and product getting out. For example, a crude lysate of the cultured microorganism can be centrifuged to obtain a supernatant. The resulting supernatant can then be applied to a chromatography column, e.g., a C-18 column, and washed with water to remove hydrophilic compounds, followed by elution of the compound(s) of interest with a solvent such as methanol. The compound(s) can then be further purified by preparative HPLC. See also, WO 2009/140394.

It will be appreciated that the various genes and modules discussed herein can be present in two or more recombinant hosts rather than a single host. When a plurality of recombinant hosts is used, they can be grown in a mixed culture to accumulate steviol and/or steviol glycosides.

Alternatively, the two or more hosts each can be grown in a separate culture medium and the product of the first culture medium, e.g., steviol, can be introduced into second culture medium to be converted into a subsequent intermediate, or into an end product such as, for example, RebA. The product produced by the second, or final host is then recovered. It will also be appreciated that in some embodiments, a recombinant host is grown using nutrient sources other than a culture medium and utilizing a system other than a fermenter.

Exemplary prokaryotic and eukaryotic species are described in more detail below. However, it will be appreciated that other species can be suitable. For example, suitable species can be in a genus such as *Agaricus, Aspergillus, Bacillus, Candida, Corynebacterium, Eremothecium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces* or *Yarrowia*. Exemplary species from such genera include *Lentinus tigrinus, Laetiporus sulphureus, Phanerochaete chrysosporium, Pichia pastoris, Cyberlindnera jadinii, Physcomitrella patens, Rhodoturula glutinis, Rhodoturula mucilaginosa, Phaffia rhodozyma, Xanthophyllomyces dendrorhous, Fusarium fujikuroi/Gibberella fujikuroi, Candida utilis, Candida glabrata, Candida albicans*, and *Yarrowia lipolytica*.

In some embodiments, a microorganism can be a prokaryote such as *Escherichia* bacteria cells, for example, *Escherichia coli* cells; *Lactobacillus* bacteria cells; *Lactococcus* bacteria cells; *Cornebacterium* bacteria cells; *Acetobacter* bacteria cells; *Acinetobacter* bacteria cells; or *Pseudomonas* bacterial cells.

In some embodiments, a microorganism can be an Ascomycete such as *Gibberella fujikuroi, Kluyveromyces lactis, Schizosaccharomyces pombe, Aspergillus niger, Yarrowia lipolytica, Ashbya gossypii*, or *S. cerevisiae*.

In some embodiments, a microorganism can be an algal cell such as *Blakeslea trispora, Dunaliella salina, Haematococcus pluvialis, Chlorella* sp., *Undaria pinnatifida, Sargassum, Laminaria japonica, Scenedesmus almeriensis* species.

In some embodiments, a microorganism can be a cyanobacterial cell such as *Blakeslea trispora, Dunaliella salina, Haematococcus pluvialis, Chlorella* sp., *Undaria pinnatifida, Sargassum, Laminaria japonica, Scenedesmus almeriensis*.

*Saccharomyces* spp.

*Saccharomyces* is a widely used chassis organism in synthetic biology, and can be used as the recombinant microorganism platform. For example, there are libraries of mutants, plasmids, detailed computer models of metabolism and other information available for *S. cerevisiae*, allowing for rational design of various modules to enhance product yield. Methods are known for making recombinant microorganisms.

*Aspergillus* spp.

*Aspergillus* species such as *A. oryzae, A. niger* and *A. sojae* are widely used microorganisms in food production and can also be used as the recombinant microorganism platform. Nucleotide sequences are available for genomes of *A. nidulans, A. fumigatus, A. oryzae, A. clavatus, A. flavus, A. niger*, and *A. terreus*, allowing rational design and modification of endogenous pathways to enhance flux and increase product yield. Metabolic models have been developed for *Aspergillus*, as well as transcriptomic studies and proteomics studies. *A. niger* is cultured for the industrial production of a number of food ingredients such as citric acid and gluconic acid, and thus species such as *A. niger* are generally suitable for producing steviol glycosides.

*E. coli*

*E. coli*, another widely used platform organism in synthetic biology, can also be used as the recombinant microorganism platform. Similar to *Saccharomyces*, there are libraries of mutants, plasmids, detailed computer models of metabolism and other information available for *E. coli*, allowing for rational design of various modules to enhance product yield. Methods similar to those described above for *Saccharomyces* can be used to make recombinant *E. coli* microorganisms.

*Agaricus, Gibberella*, and *Phanerochaete* spp.

*Agaricus, Gibberella*, and *Phanerochaete* spp. can be useful because they are known to produce large amounts of isoprenoids in culture. Thus, the terpene precursors for producing large amounts of steviol glycosides are already produced by endogenous genes. Thus, modules comprising recombinant genes for steviol glycoside biosynthesis polypeptides can be introduced into species from such genera without the necessity of introducing mevalonate or MEP pathway genes.

*Arxula adeninivorans* (*Blastobotrys adeninivorans*)

*Arxula adeninivorans* is dimorphic yeast (it grows as budding yeast like the baker's yeast up to a temperature of 42° C., above this threshold it grows in a filamentous form) with unusual biochemical characteristics. It can grow on a wide range of substrates and can assimilate nitrate. It has successfully been applied to the generation of strains that can produce natural plastics or the development of a biosensor for estrogens in environmental samples.

*Yarrowia lipolytica*

*Yarrowia lipolytica* is dimorphic yeast (see *Arxula adeninivorans*) and belongs to the family Hemiascomycetes. The entire genome of *Yarrowia lipolytica* is known. *Yarrowia* species is aerobic and considered to be non-pathogenic. *Yarrowia* is efficient in using hydrophobic substrates (e.g. alkanes, fatty acids, oils) and can grow on sugars. It has a high potential for industrial applications and is an oleaginous microorgamism. *Yarrowia lipolytica* can accumulate lipid content to approximately 40% of its dry cell weight and is a model organism for lipid accumulation and remobilization. See e.g., Nicaud, 2012, *Yeast* 29(10):409-18; Beopoulos et al., 2009, *Biochimie* 91(6):692-6; Bankar et al., 2009, *Appl Microbiol Biotechnol.* 84(5):847-65.

*Rhodotorula* sp.

*Rhodotorula* is unicellular, pigmented yeast. The oleaginous red yeast, *Rhodotorula glutinis*, has been shown to produce lipids and carotenoids from crude glycerol (Saenge et al., 2011, *Process Biochemistry* 46(1):210-8). *Rhodotorula toruloides* strains have been shown to be an efficient fed-batch fermentation system for improved biomass and lipid productivity (Li et al., 2007, Enzyme and Microbial Technology 41:312-7).

*Rhodosporidium toruloides*

*Rhodosporidium toruloides* is oleaginous yeast and useful for engineering lipid-production pathways (See e.g. Zhu et al., 2013, *Nature Commun.* 3:1112; Ageitos et al., 2011, *Applied Microbiology and Biotechnology* 90(4):1219-27).

*Candida boidinii*

*Candida boidinii* is methylotrophic yeast (it can grow on methanol). Like other methylotrophic species such as *Hansenula polymorpha* and *Pichia pastoris*, it provides an excellent platform for producing heterologous proteins. Yields in a multigram range of a secreted foreign protein have been reported. A computational method, IPRO, recently predicted mutations that experimentally switched the cofactor specificity of *Candida boidinii* xylose reductase from NADPH to NADH. See, e.g., Mattanovich et al., 2012, *Methods Mol Biol.* 824:329-58; Khoury et al., 2009, *Protein Sci.* 18(10):2125-38.

*Hansenula polymorpha* (*Pichia anqusta*)

*Hansenula polymorpha* is methylotrophic yeast (see *Candida boidinii*). It can furthermore grow on a wide range of other substrates; it is thermo-tolerant and can assimilate nitrate (see also *Kluyveromyces lactis*). It has been applied to producing hepatitis B vaccines, insulin and interferon alpha-2a for the treatment of hepatitis C, furthermore to a range of technical enzymes. See, e.g., Xu et al., 2014, *Virol Sin.* 29(6):403-9.

*Kluyveromyces lactis*

*Kluyveromyces lactis* is yeast regularly applied to the production of kefir. It can grow on several sugars, most importantly on lactose which is present in milk and whey. It has successfully been applied among others for producing chymosin (an enzyme that is usually present in the stomach of calves) for producing cheese. Production takes place in fermenters on a 40,000 L scale. See, e.g., van Ooyen et al., 2006, *FEMS Yeast Res.* 6(3):381-92.

*Pichia pastoris*

*Pichia pastoris* is methylotrophic yeast (see *Candida boidinii* and *Hansenula polymorpha*). It provides an efficient platform for producing foreign proteins. Platform elements are available as a kit and it is worldwide used in academia for producing proteins. Strains have been engineered that can produce complex human N-glycan (yeast glycans are similar but not identical to those found in humans). See, e.g., Piirainen et al., 2014, *N Biotechnol.* 31(6):532-7.

*Physcomitrella* spp.

*Physcomitrella* mosses, when grown in suspension culture, have characteristics similar to yeast or other fungal cultures. This genera can be used for producing plant secondary metabolites, which can be difficult to produce in other types of cells.

It will be appreciated that the recombinant host cell disclosed herein can comprise a plant cell, comprising a plant cell that is grown in a plant, a mammalian cell, an insect cell, a fungal cell, comprising a yeast cell, wherein the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous,* or *Candida albicans* species or is a Saccharomycete or is a *Saccharomyces cerevisiae* cell, an algal cell or a bacterial cell, comprising *Escherichia* cell, *Lactobacillus* cell, *Lactococcus* cell, *Cornebacterium* cell, *Acetobacter* cell, *Acinetobacter* cell, or *Pseudomonas* cell.

Steviol Glycoside Compositions

Steviol glycosides do not necessarily have equivalent performance in different food systems. It is therefore desirable to have the ability to direct the synthesis to steviol glycoside compositions of choice. Recombinant hosts described herein can produce compositions that are selectively enriched for specific steviol glycosides (e.g., RebD or RebM) and have a consistent taste profile. As used herein, the term "enriched" is used to describe a steviol glycoside composition with an increased proportion of a particular steviol glycoside, compared to a steviol glycoside composition (extract) from a *stevia* plant. Thus, the recombinant hosts described herein can facilitate the production of compositions that are tailored to meet the sweetening profile desired for a given food product and that have a proportion of each steviol glycoside that is consistent from batch to batch. In some embodiments, hosts described herein do not produce or produce a reduced amount of undesired plant by-products found in *Stevia* extracts. Thus, steviol glycoside compositions produced by the recombinant hosts described herein are distinguishable from compositions derived from *Stevia* plants.

The amount of an individual steviol glycoside (e.g., RebA, RebB, RebD, or RebM) accumulated can be from about 1 to about 7,000 mg/L, e.g., about 1 to about 10 mg/L, about 3 to about 10 mg/L, about 5 to about 20 mg/L, about 10 to about 50 mg/L, about 10 to about 100 mg/L, about 25 to about 500 mg/L, about 100 to about 1,500 mg/L, or about 200 to about 1,000 mg/L, at least about 1,000 mg/L, at least about 1,200 mg/L, at least about at least 1,400 mg/L, at least about 1,600 mg/L, at least about 1,800 mg/L, at least about 2,800 mg/L, or at least about 7,000 mg/L. In some aspects, the amount of an individual steviol glycoside can exceed 7,000 mg/L. The amount of a combination of steviol glycosides (e.g., RebA, RebB, RebD, or RebM) accumulated can be from about 1 mg/L to about 7,000 mg/L, e.g., about 200 to about 1,500, at least about 2,000 mg/L, at least about 3,000 mg/L, at least about 4,000 mg/L, at least about 5,000 mg/L, at least about 6,000 mg/L, or at least about 7,000 mg/L. In some aspects, the amount of a combination of steviol glycosides can exceed 7,000 mg/L. In general, longer culture times will lead to greater amounts of product. Thus, the recombinant microorganism can be cultured for from 1 day to 7 days, from 1 day to 5 days, from 3 days to 5 days, about 3 days, about 4 days, or about 5 days.

It will be appreciated that the various genes and modules discussed herein can be present in two or more recombinant microorganisms rather than a single microorganism. When a plurality of recombinant microorganisms is used, they can be grown in a mixed culture to produce steviol and/or steviol glycosides. For example, a first microorganism can comprise one or more biosynthesis genes for producing a steviol glycoside precursor, while a second microorganism comprises steviol glycoside biosynthesis genes. The product produced by the second, or final microorganism is then recovered. It will also be appreciated that in some embodiments, a recombinant microorganism is grown using nutrient sources other than a culture medium and utilizing a system other than a fermenter.

Alternatively, the two or more microorganisms each can be grown in a separate culture medium and the product of the first culture medium, e.g., steviol, can be introduced into second culture medium to be converted into a subsequent intermediate, or into an end product such as RebA. The product produced by the second, or final microorganism is then recovered. It will also be appreciated that in some embodiments, a recombinant microorganism is grown using nutrient sources other than a culture medium and utilizing a system other than a fermenter.

Steviol glycosides and compositions obtained by the methods disclosed herein can be used to make food products, dietary supplements and sweetener compositions. See, e.g., WO 2011/153378, WO 2013/022989, WO 2014/122227, and WO 2014/122328.

For example, substantially pure steviol or steviol glycoside such as RebM or RebD can be included in food products such as ice cream, carbonated beverages, fruit juices, yogurts, baked goods, chewing gums, hard and soft candies, and sauces. Substantially pure steviol or steviol glycoside can also be included in non-food products such as pharmaceutical products, medicinal products, dietary supplements and nutritional supplements. Substantially pure steviol or steviol glycosides may also be included in animal feed products for both the agriculture industry and the companion animal industry. Alternatively, a mixture of steviol and/or steviol glycosides can be made by culturing recombinant microorganisms separately, each producing a specific steviol or steviol glycoside, recovering the steviol or steviol glycoside in substantially pure form from each microorganism and then combining the compounds to obtain a mixture comprising each compound in the desired proportion. The recombinant microorganisms described herein permit more precise and consistent mixtures to be obtained compared to current *Stevia* products.

In another alternative, a substantially pure steviol or steviol glycoside can be incorporated into a food product along with other sweeteners, e.g. saccharin, dextrose, sucrose, fructose, erythritol, aspartame, sucralose, monatin, or acesulfame potassium. The weight ratio of steviol or steviol glycoside relative to other sweeteners can be varied as desired to achieve a satisfactory taste in the final food product. See, e.g., U.S. 2007/0128311. In some embodiments, the steviol or steviol glycoside may be provided with a flavor (e.g., citrus) as a flavor modulator.

Compositions produced by a recombinant microorganism described herein can be incorporated into food products. For example, a steviol glycoside composition produced by a recombinant microorganism can be incorporated into a food product in an amount ranging from about 20 mg steviol glycoside/kg food product to about 1800 mg steviol glycoside/kg food product on a dry weight basis, depending on the type of steviol glycoside and food product. For example, a steviol glycoside composition produced by a recombinant microorganism can be incorporated into a dessert, cold confectionary (e.g., ice cream), dairy product (e.g., yogurt), or beverage (e.g., a carbonated beverage) such that the food product has a maximum of 500 mg steviol glycoside/kg food on a dry weight basis. A steviol glycoside composition produced by a recombinant microorganism can be incorporated into a baked good (e.g., a biscuit) such that the food product has a maximum of 300 mg steviol glycoside/kg food on a dry weight basis. A steviol glycoside composition produced by a recombinant microorganism can be incorporated into a sauce (e.g., chocolate syrup) or vegetable product (e.g., pickles) such that the food product has a maximum of 1000 mg steviol glycoside/kg food on a dry weight basis. A steviol glycoside composition produced by a recombinant microorganism can be incorporated into bread such that the food product has a maximum of 160 mg steviol glycoside/kg food on a dry weight basis. A steviol glycoside composition produced by a recombinant microorganism, plant, or plant cell can be incorporated into a hard or soft candy such that the food product has a maximum of 1600 mg steviol glycoside/kg food on a dry weight basis. A steviol glycoside composition produced by a recombinant microorganism, plant, or plant cell can be incorporated into a processed fruit product (e.g., fruit juices, fruit filling, jams, and jellies) such that the food product has a maximum of 1000 mg steviol glycoside/kg food on a dry weight basis. In some embodiments, a steviol glycoside composition produced herein is a component of a pharmaceutical composition. See, e.g., Steviol Glycosides Chemical and Technical Assessment 69th JECFA, 2007, prepared by Harriet Wallin, Food Agric. Org.; EFSA Panel on Food Additives and Nutrient Sources added to Food (ANS), "Scientific Opinion on the safety of steviol glycosides for the proposed uses as a food additive," 2010, EFSA Journal 8(4):1537; U.S. Food and Drug Administration GRAS Notice 323; U.S Food and Drug Administration GRAS Notice 329; WO 2011/037959; WO 2010/146463; WO 2011/046423; and WO 2011/056834.

For example, such a steviol glycoside composition can have from 90-99 weight % RebA and an undetectable amount of *stevia* plant-derived contaminants, and be incorporated into a food product at from 25-1600 mg/kg, e.g., 100-500 mg/kg, 25-100 mg/kg, 250-1000 mg/kg, 50-500 mg/kg or 500-1000 mg/kg on a dry weight basis.

Such a steviol glycoside composition can be a RebB-enriched composition having greater than 3 weight % RebB and be incorporated into the food product such that the amount of RebB in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebB-enriched composition has an undetectable amount of *stevia* plant-derived contaminants.

Such a steviol glycoside composition can be a RebD-enriched composition having greater than 3 weight % RebD and be incorporated into the food product such that the amount of RebD in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebD-enriched composition has an undetectable amount of *stevia* plant-derived contaminants.

Such a steviol glycoside composition can be a RebE-enriched composition having greater than 3 weight % RebE and be incorporated into the food product such that the amount of RebE in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebE-enriched composition has an undetectable amount of *stevia* plant-derived contaminants.

Such a steviol glycoside composition can be a RebM-enriched composition having greater than 3 weight % RebM and be incorporated into the food product such that the amount of RebM in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebM-enriched composition has an undetectable amount of *stevia* plant-derived contaminants.

In some embodiments, a substantially pure steviol or steviol glycoside is incorporated into a tabletop sweetener or "cup-for-cup" product. Such products typically are diluted to the appropriate sweetness level with one or more bulking agents, e.g., maltodextrins, known to those skilled in the art. Steviol glycoside compositions enriched for RebA, RebB, RebD, RebE, or RebM, can be package in a sachet, for example, at from 10,000 to 30,000 mg steviol glycoside/kg product on a dry weight basis, for tabletop use. In some embodiments, a steviol glycoside produced in vitro, in vivo, or by whole cell bioconversion The invention will be further described in the following examples, which do not limit the scope of the invention described in the claims.

EXAMPLES

Example 1. LC-MS Analytical Procedures

LC-MS analyses were performed on Waters ACQUITY UPLC® (Waters Corporation) with a Waters ACQUITY UPLC® BEH C18 column (2.1×50 mm, 1.7 µm particles, 130 Å pore size) equipped with a pre-column (2.1×5 mm, 1.7 µm particles, 130 Å pore size) coupled to a Waters ACQUITY TQD triple quadropole mass spectrometer with electrospray ionization (ESI) operated in negative ionization mode. Compound separation was achieved using a gradient of the two mobile phases: A (water with 0.1% formic acid) and B (MeCN with 0.1% formic acid) by increasing from 20% to 50% B between 0.3 to 2.0 min, increasing to 100% B at 2.01 min and holding 100% B for 0.6 min, and re-equilibrating for 0.6 min. The flow rate was 0.6 mL/min, and the column temperature was set at 55° C. Steviol glycosides were monitored using SIM (Single Ion Monitoring) and quantified by comparing against authentic standards. See Table 1 for m/z trace and retention time values of steviol glycosides detected.

TABLE 1

LC-MS Analytical Data for Glycosides of ent-kaurenoic acid, ent-kaurenol, and Steviol.

| Compound | MS Trace | RT (min) | Table(s) |
|---|---|---|---|
| steviol + 6Glc (isomer 1) [also referred to as compound 6.1] | 1289.53 | 0.87 | 5, 9, 13, 17 |
| steviol + 7Glc (isomer 2) [also referred to as compound 7.2] | 1451.581 | 0.94 | 5, 9, 13, 17 |
| steviol + 6Glc (#23) (also referred to as compound 6.23) | 1289.53 | 0.97 | 5, 9, 13, 17 |
| RebE | 965.42 | 1.06 | 4, 8, 12, 16 |
| RebD | 1127.48 | 1.08 | 4, 8, 12, 16 |
| RebM | 1289.53 | 1.15 | 4, 8, 12, 16 |
| steviol + 7Glc (isomer 5) (also referred to as compound 7.5) | 1451.581 | 1.09 | 5, 9, 13, 14 |
| steviol + 4Glc (#26) (also referred to as compound 4.26) | 965.42 | 1.21 | 5, 9, 13, 14 |
| steviol + 5Glc (#24) (also referred to as compound 5.24) | 1127.48 | 1.18 | 5, 9, 13, 14 |
| steviol + 5Glc (#25) (also referred to as compound 5.25) | 1127.48 | 1.40 | 5, 9, 13, 14 |
| RebA | 965.42 | 1.43 | 4, 8, 12, 16 |
| 1,2-stevioside | 803.37 | 1.43 | 5, 9, 13, 14 |
| steviol + 4Glc (#33) (also referred to as compound 4.33) | 965.42 | 1.49 | 5, 9, 13, 14 |
| 1,3-stevioside (RebG) | 803.37 | 1.60 | 5, 9, 13, 14 |
| rubusoside | 641.32 | 1.67 | 4, 8, 12, 16 |
| RebB | 803.37 | 1.76 | 4, 8, 12, 16 |
| steviol-1,2-bioside | 641.32 | 1.80 | 4, 8, 12, 16 |
| steviol-1,3-bioside | 641.32 | 1.95 | 5, 9, 13, 14 |
| 19-SMG | 525.27 | 1.98 | 5, 9, 13, 14 |
| 13-SMG | 479.26 | 2.04 | 4, 8, 12, 16 |
| ent-kaurenoic acid + 3Glc (isomer 1) (also referred to as compound KA3.1) | 787.37 | 2.16 | 6, 10, 14, 18 |
| ent-kaurenoic acid + 3Glc (isomer 2) (also referred to as compound KA3.2) | 787.37 | 2.28 | 6, 10, 14, 18 |
| ent-kaurenol + 3Glc (isomer 1) co-eluted with ent-kaurenol + 3Glc (#6) (also referred to as compounds KL3.1 and KL3.6) | 773.4 | 2.36 | 6, 10 |
| ent-kaurenoic acid + 2Glc (#7) (also referred to as compound KA2.7) | 625.32 | 2.35 | 6, 10, 14, 18 |
| ent-kaurenol + 2Glc (#8) (also referred to as compound KL2.8) | 611.34 | 2.38 | 10 |
| steviol | 317.21 | 2.39 | |

Example 2. Strain Engineering

Steviol glycoside-producing S. cerevisiae strains were constructed as described in WO 2011/153378, WO 2013/022989, WO 2014/122227, and WO 2014/122328, each of which is incorporated by reference in their entirety. For example, yeast strains comprising one or more copies of: arecombinant gene encoding aGGPPS polypeptide (SEQ ID NO: 19, SEQ ID NO:20), a recombinant gene encoding atruncated COPS polypeptide (SEQ ID NO:39, SEQ ID NO:40), a recombinant gene encoding an KSpolypeptide (SEQ ID NO:51, SEQ ID NO:52), arecombinant gene encoding a recombinant KO polypeptide (SEQ ID NO:59, SEQ ID NO:60), a recombinant gene encoding an ATR2 polypeptide (SEQ ID NO:91, SEQ ID NO:92), a recombinant gene encoding an EUGT11 polypeptide (SEQ ID NO:14/SEQ ID NO:15, SEQ ID NO:16), a recombinant gene encoding an KAH polypeptide (SEQ ID NO:93, SEQ ID NO:94), a recombinant gene encoding an CPR8 polypeptide (SEQ ID NO:85, SEQ ID NO:86), a recombinant gene encoding an UGT85C2 polypeptide (SEQ ID NO:5/SEQ ID NO:6/SEQ ID NO:149, SEQ ID NO:7) or a UGT85C2 variant (or functional homolog) of SEQ ID NO:7, a recombinant gene encoding an UGT74G1 polypeptide (SEQ ID NO:3, SEQ ID NO:4) of a UGT74G1 variant (or functional homolog) of SEQ ID NO:4, a recombinant gene encoding an UGT76G1 polypeptide (SEQ ID NO:8, SEQ ID NO:9) or a UGT76G1 variant (or functional homolog) of SEQ ID NO:9, and a recombinant gene encoding an UGT91D2e polypeptide (SEQ ID NO:10, SEQ ID NO:11) and/or a UGT91D2e variant (or functional homolog) of SEQ ID NO:11 such as a UGT91D2e-b (SEQ ID NO:12, SEQ ID NO:13) polypeptide were engineered to accumulate steviol glycosides.

Example 3. Modulation of Substrate-Specificity of UGT74G1

UGT74G1 is expressed in the *Stevia* plant and catalyzes, among other reactions, the conversion of 13-SMG to rubusoside. Because UGT74G1 demonstrates substrate promiscuity and 13-SMG accumulates in steviol glycoside-producing hosts, variants for catalyzing 13-SMG to rubusoside were identified.

A homology model of UGT74G1 was generated from the crystal structure of UGT78K6 (PDB:2C1Z), using Rebaudioside B (RebB) as a substrate for docking analysis. RebB was chosen because it is the largest steviol glycoside that UGT74G1 is known to have activity on. The homology model was generated using the modeling suite in the Molecular Operating Environment (MOE) software (Chemical Computing Group).

Twenty-seven amino acids were determined to be within 4.5 Å of RebB in the homology model. Results are shown in Table 2. A UGT74G1 site saturation library (SSL) screen of the 27 amino acids was prepared using GENEART™ (Thermo Fisher Scientific) in a GENEART™ codon optimized version of UGT74G1 (SEQ ID NO:1, SEQ ID NO:4). Histidine 23 (i.e., His23) is fully conserved and is believed to be catalytically active, and as such was not included in the site saturation library. 460 site saturated variants were expressed with a p416-GPD vector in a steviol glycoside-producing S. cerevisiae strain as described in Example 2, further engineered to disrupt expression of native UGT74G1 polypeptide, and incubated in 1 mL synthetic complete (SC) uracil dropout media at 30° C. for five days, shaking at 400 rpm. 50 µL of each culture was transferred into 50 µL DMSO, incubated at 80° C. for 10 minutes, and centrifuged at 3220 g for 5 minutes. 15 µL of the resulting supernatant was then transferred to 105 µL 50% DMSO for LC-MS analysis.

TABLE 2

UGT74G1 Residues Identified in Homology Model

| No. | Residue near Reb B |
|---|---|
| 1 | F18 |
| 2 | L20 |
| 3 | Q21 |
| 4 | H23 |
| 5 | M79 |
| 6 | S80 |
| 7 | A81 |
| 8 | G82 |
| 9 | E83 |
| 10 | Y85 |
| 11 | L86 |
| 12 | M119 |
| 13 | Q140 |
| 14 | Y148 |
| 15 | L179 |
| 16 | H184 |
| 17 | E185 |
| 18 | W191 |
| 19 | M194 |
| 20 | L195 |
| 21 | L284 |
| 22 | V285 |
| 23 | K286 |
| 24 | Q375 |
| 25 | F376 |
| 26 | S377 |
| 27 | D378 |

Figure 3:
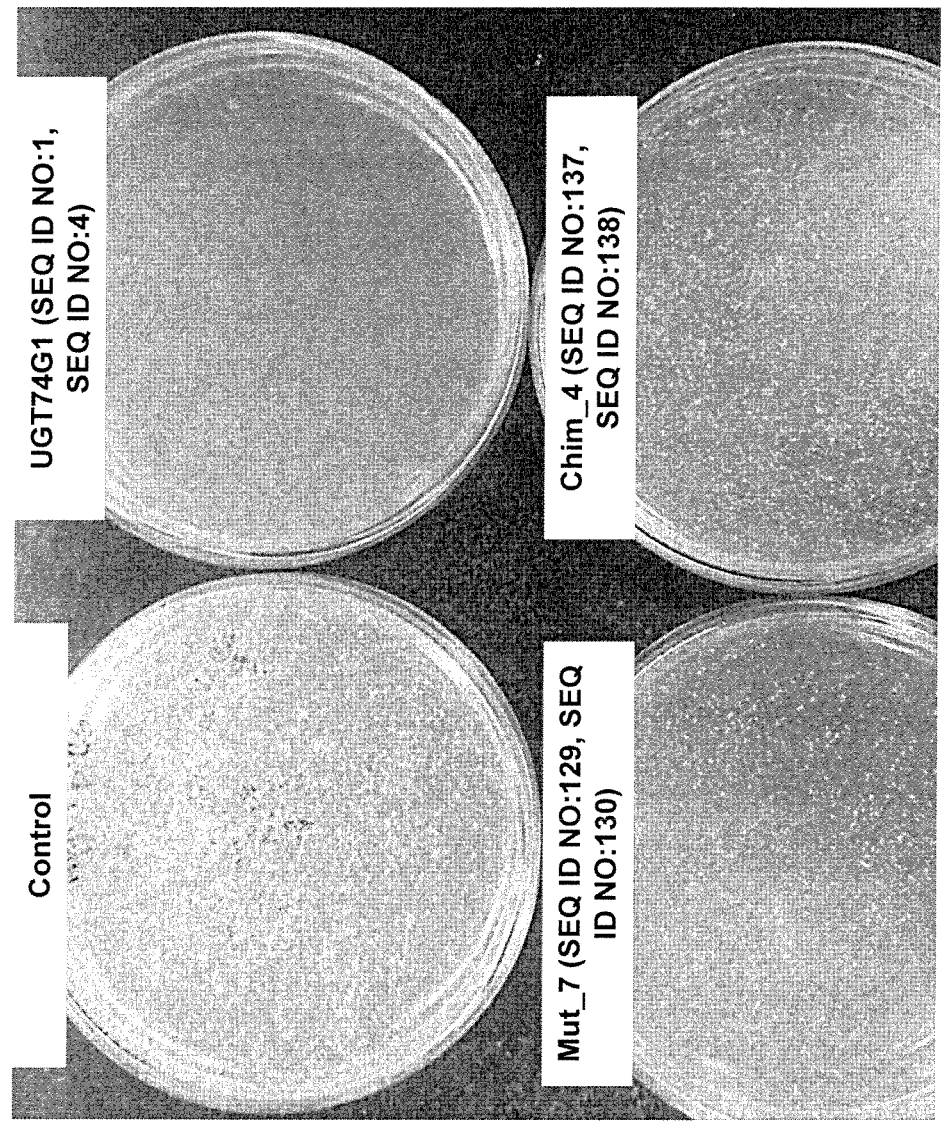
FIG. 3 shows cultures of a control *S. cerevisiae* strain, an *S. cerevisiae* strain expressing UGT74G1 (SEQ ID NO:1, SEQ ID NO:4), an *S. cerevisiae* strain expressing UGT74G1 Var_7 (SEQ ID NO:129, SEQ ID NO:130), and an *S. cerevisiae* strain expressing Chim_4 (SEQ ID NO:137, SEQ ID NO:138).
Figure 4:
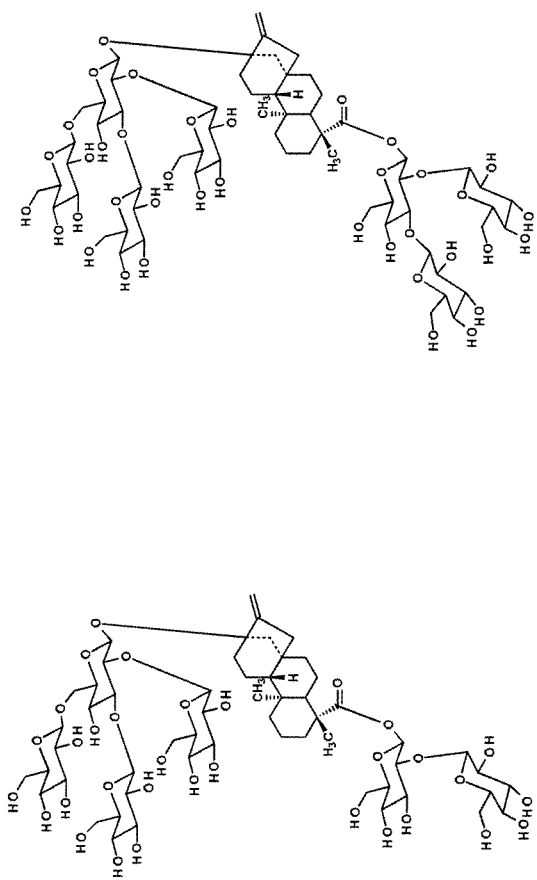
FIG. 4 shows the structures of steviol+6Glc (isomer 1) and steviol+7Glc (isomer 2).
Figure 5:
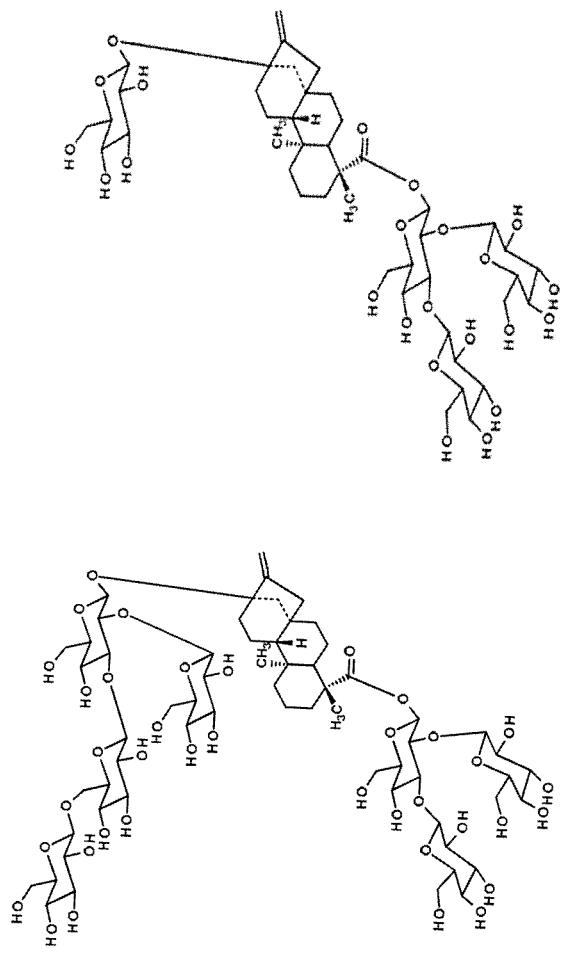
FIG. 5 shows the structures of steviol+7Glc (isomer 5) and steviol+4Glc (#26).
Figure 6:
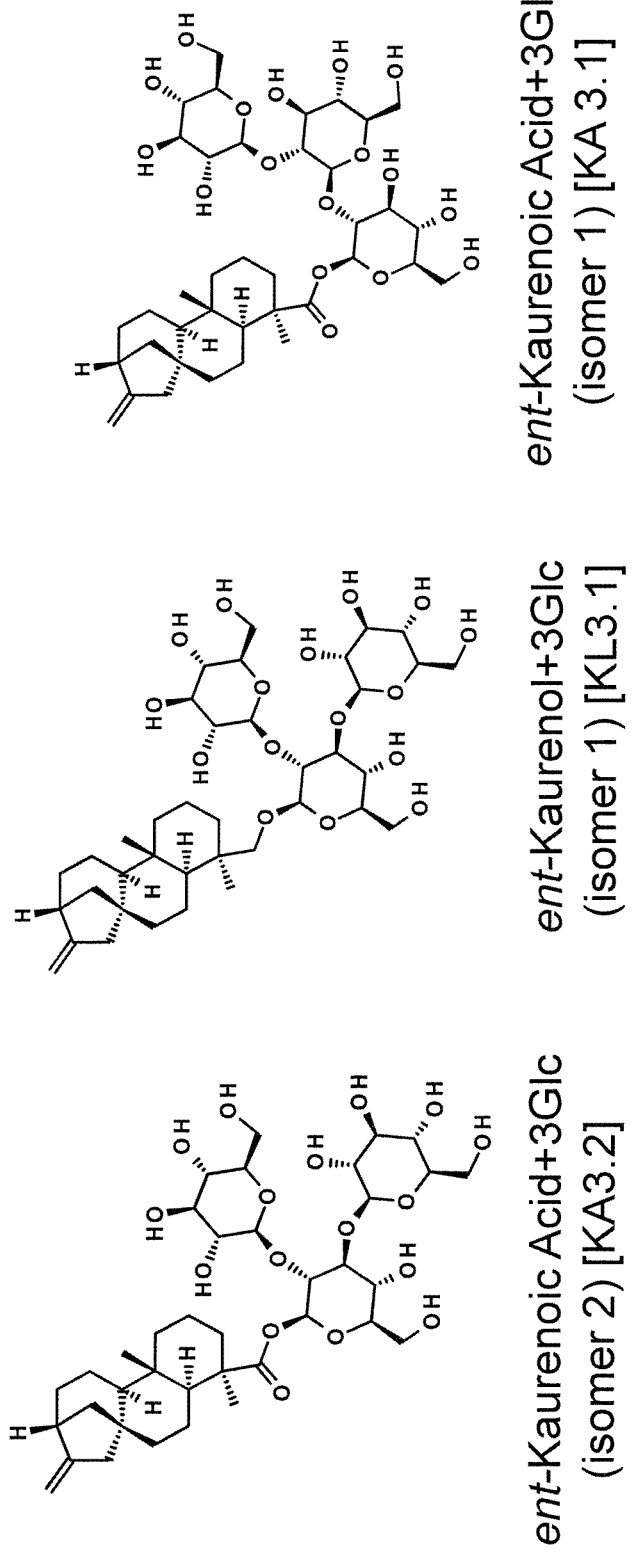
FIG. 6 shows the structures of ent-kaurenoic acid+3Glc (isomer 2), ent-kaurenol+3Glc (isomer 1), and ent-kaurenoic acid+3Glc (isomer 1).
Figure 7:
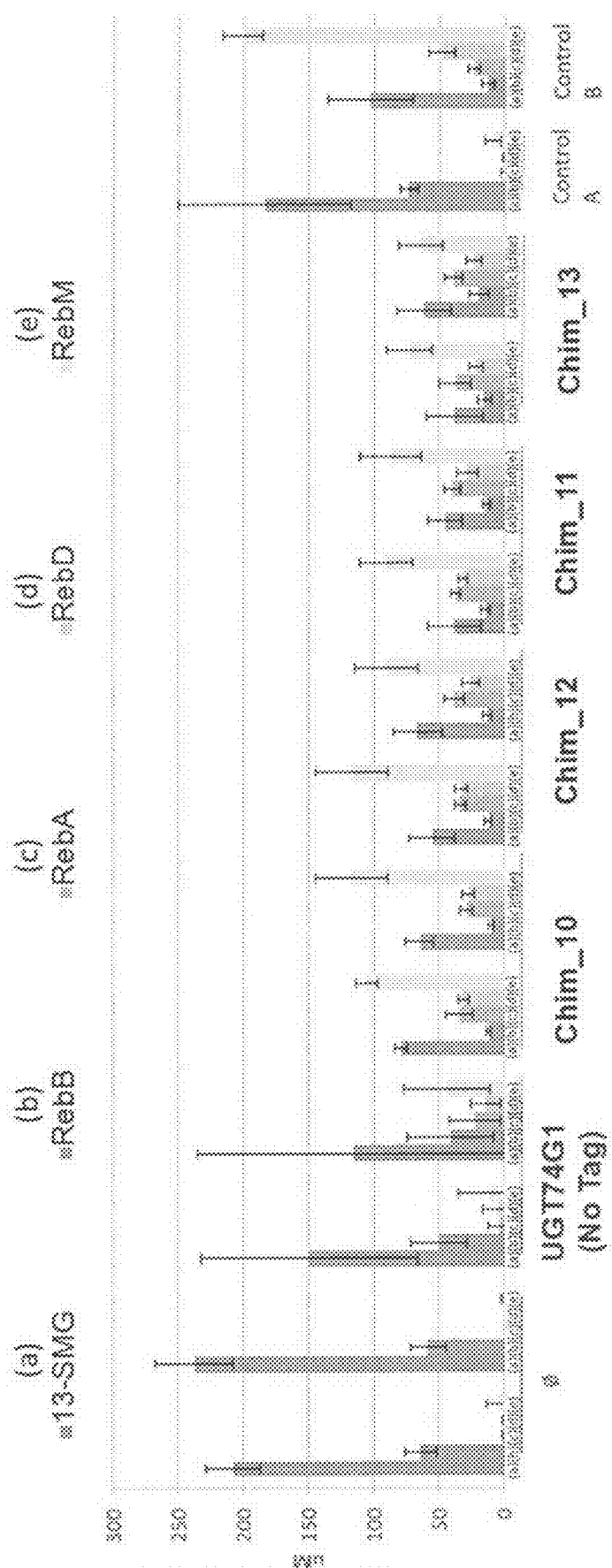
FIG. 7 shows accumulation of 13-SMG, RebA, RebB, RebD, and RebM by steviol glycoside-producing *S. cerevisiae* strains expressing tagged UGT74G1 polypeptides (Strain 1). Legend: Ø are control strains (transformed with an empty plasmid) derived from strain control A (engineered to disrupt expression of native UGT74G1 polypeptide). Control B represents a typical steviol glycoside-producing strain and is herein included as reference. Two different integrations sites were used to express the tagged UGT74G1 polypeptides described in Table 15 of Example 7, below: XII-1 (left set of bars) or XII-5 (right set of bars). Each value represents an average of 6 independent clones. See Example 7. For each variant (for each set of bars), the bars correspond to, from left to right, 13-SMG, RebB, RebA, RebD, and RebM accumulation.
Figure 8:
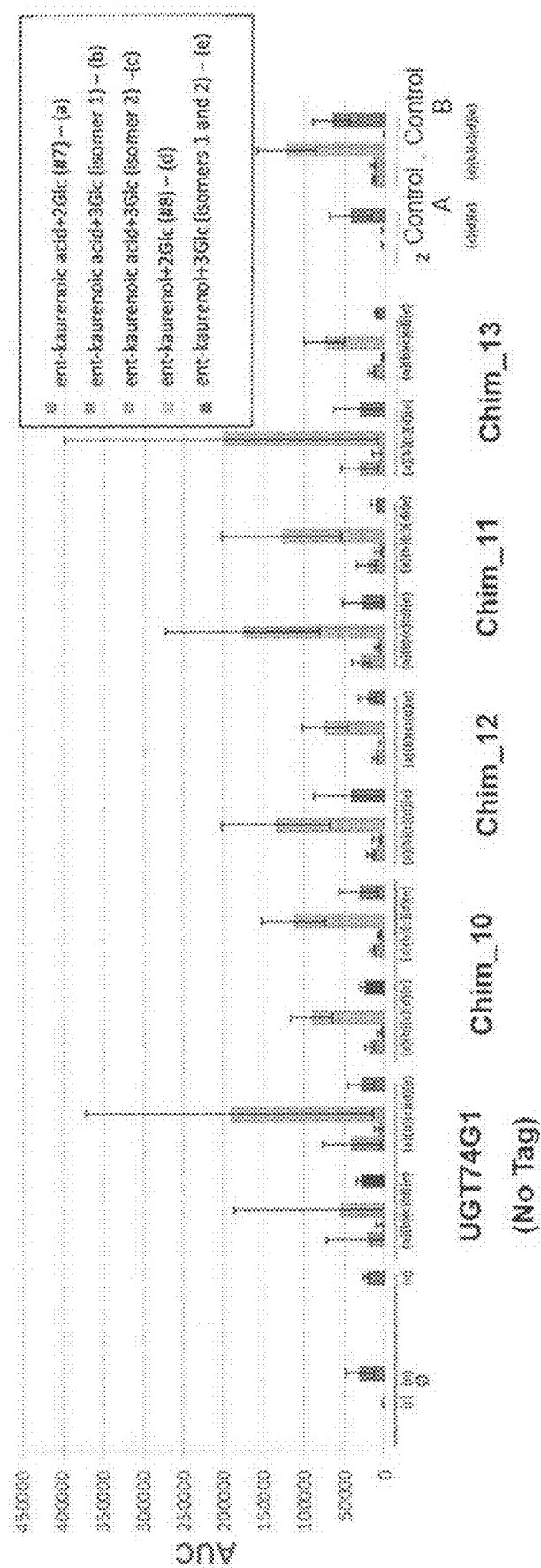
FIG. 8 shows accumulation of glycosylated ent-kaurenoic acid and glycosylated ent-kaurenol by steviol glycoside-producing *S. cerevisiae* strains expressing tagged UGT74G1 polypeptides (strain 1). See, Example 7. For legend, see description of FIG. 7. For each variant (for each set of bars), the bars correspond to, from left to right, ent-kaurenoic acid+2Glc (#7), ent-kaurenoic acid+3Glc (isomer 1), ent-kaurenoic acid+3Glc (isomer 2), ent-kaurenol+2Glc (#8), and ent-kaurenol+3Glc (isomers 1 and 2) accumulation.
Figure 9:
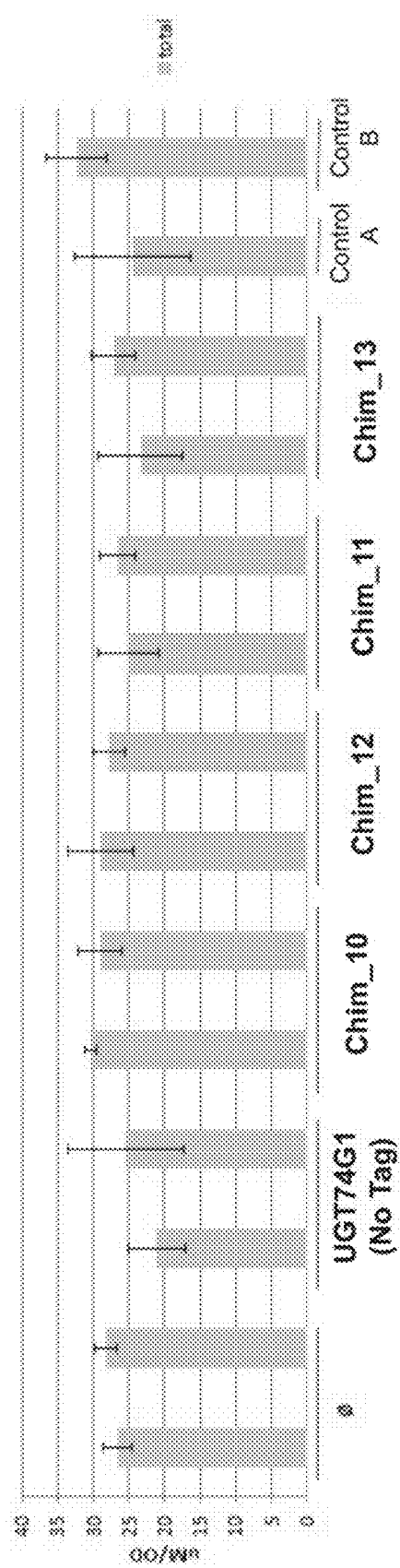
FIG. 9 shows total steviol glycoside accumulation by steviol glycoside-producing *S. cerevisiae* strains expressing tagged UGT74G1 polypeptides (Strain1). See Example 7. Each tagged UGT74G1 polypeptide was expressed from 2 different intregration sites (XII-1 (left bar) or XII-5 (right bar)). Each bar represents an average of 6 independent clones. For legend, see description of FIG. 7.

Seven candidates were selected from the SSL variants and sequenced (See, Table 3). These mutations impart an increase in viability to steviol glycoside-producing *S. cerevisiae* strains when such a mutated UGT74G1 is expressed (See, FIG. 3).

TABLE 3

Sequenced UGT74G1 Variants

| Name | Nucleotide Changes | Amino Acid Changes | SEQ ID NO |
|---|---|---|---|
| Var_1 | A856G | K286E | 2, 118 |
| Var_2 | A235G<br>G237T | M79V | 119, 120 |
| Var_3 | T1129C<br>C1130A<br>T1131A | S377Q | 121, 122 |
| Var_4 | C239G | S80C | 123, 124 |
| Var_5 | A779C<br>A856T<br>A857G<br>A858T | N260T<br>K286C | 125, 126 |
| Var_6 | C550G<br>A551T<br>C552T | H184V | 127, 128 |
| Var_7 | G241T<br>C242G<br>T243G<br>G247A | A81W<br>E83K | 129, 130 |

Concentration (μM) values or area-under-the-curve (AUC) values for LC-MS derived peaks corresponding to several glycosides of steviol, ent-kaurenols (KL), and ent-kaurenoic acids (KA) were determined for each *S. cerevisiae* strain expressing an UGT74G1 SSL candidate. Results, normalized to cell $OD_{600}$ (μM/OD or AUC/OD) are shown in Tables 4-6.

TABLE 4

Production of 13-SMG, steviol-1,2-bioside, rubusosideRebB, RebA, RebE, RebD and Reb M (in $\mu M/OD_{600}$) using UGT74G1 SSL candidates.

| | 13-SMG | Steviol-1,2-bioside | Rubusoside | RebB | RebA | RebE | RebD | RebM |
|---|---|---|---|---|---|---|---|---|
| UGT74G1 | 1.05 ± 0.17 | 0.02 ± 0.01 | 0.01 ± 0.02 | 0.58 ± 0.06 | 0.62 ± 0.08 | N/A | 0.68 ± 0.10 | 1.81 ± 0.23 |
| Mut 1 | 1.34 ± 0.15 | 0.02 ± 0.00 | 0.03 ± 0.01 | 0.90 ± 0.02 | 0.71 ± 0.03 | N/A | 0.59 ± 0.02 | 1.88 ± 0.12 |
| Mut 2 | 1.41 ± 0.01 | 0.02 ± 0.00 | 0.03 ± 0.01 | 0.82 ± 0.04 | 0.80 ± 0.07 | 0.01 ± 0.01 | 0.79 ± 0.06 | 2.38 ± 0.11 |
| Mut 3 | 6.07 ± 0.21 | 0.07 ± 0.01 | N/A | 2.81 ± 0.17 | 0.17 ± 0.02 | N/A | 0.25 ± 0.01 | 1.01 ± 0.06 |
| Mut 4 | 1.61 ± 0.06 | 0.02 ± 0.00 | 0.03 ± 0.00 | 0.90 ± 0.03 | 0.77 ± 0.01 | 0.01 ± 0.00 | 0.73 ± 0.01 | 2.30 ± 0.12 |
| Mut 5 | 1.36 ± 0.14 | 0.02 ± 0.00 | 0.04 ± 0.00 | 0.82 ± 0.12 | 0.76 ± 0.09 | 0.01 ± 0.01 | 0.66 ± 0.09 | 2.19 ± 0.32 |
| Mut 6 | 1.50 ± 0.09 | 0.02 ± 0.00 | 0.03 ± 0.01 | 0.91 ± 0.03 | 0.80 ± 0.04 | 0.01 ± 0.00 | 0.81 ± 0.03 | 2.44 ± 0.08 |
| Mut 7 | 2.15 ± 0.09 | 0.02 ± 0.00 | 0.03 ± 0.01 | 1.11 ± 0.04 | 0.92 ± 0.07 | 0.01 ± 0.00 | 0.97 ± 0.06 | 3.00 ± 0.18 |

TABLE 5

Production of 19-SMG, steviol-1,3-bioside, 1,2-stevioside, 1,3-stevioside, and compounds 4.26, 4.33, 5.24, 5.25, 6.1, 6.23, 7.2, and 7.5 (in $AUC/OD_{600}$) using UGT74G1 SSL candidates.

| | 19-SMG | steviol-1,3-bioside | 1,2-stevioside | 1,3-stevioside (RebG) | # 4.26 | # 4.33 | # 5.24 | # 5.25 | # 6.1 | # 6.23 | # 7.2 | # 7.5 |
|---|---|---|---|---|---|---|---|---|---|---|---|---|
| UGT74G1 | 420 ± 50 | N/A | 257 ± 56 | N/A | 509 ± 66 | 164 ± 41 | 145 ± 13 | 130 ± 87 | 91 ± 11 | N/A | 210 ± 53 | 231 ± 284 |
| Var_1 | 405 ± 28 | 54 ± 37 | 180 ± 7 | N/A | 898 ± 26 | 207 ± 28 | 293 ± 33 | 180 ± 7 | 16 ± 32 | N/A | 167 ± 36 | 548 ± 69 |
| Var_2 | 594 ± 132 | 16 ± 31 | 230 ± 41 | 16 ± 32 | 1,040 ± 75 | 192 ± 29 | 154 ± 39 | 230 ± 41 | 76 ± 11 | 43 ± 86 | 248 ± 45 | 381 ± 119 |
| Var_3 | N/A | 107 ± 11 | N/A | N/A | 191 ± 32 | 641 ± 66 | N/A | N/A | 25 ± 29 | N/A | 121 ± 12 | N/A |
| Var_4 | 399 ± 20 | N/A | 195 ± 19 | N/A | 1,060 ± 66 | 210 ± 28 | 132 ± 96 | 195 ± 19 | 52 ± 36 | N/A | 223 ± 39 | 196 ± 255 |
| Var_5 | 544 ± 83 | 16 ± 32 | 203 ± 23 | 20 ± 39 | 1,179 ± 98 | 168 ± 29 | 185 ± 61 | 203 ± 23 | 35 ± 43 | N/A | 204 ± 46 | 238 ± 168 |
| Var_6 | 487 ± 49 | N/A | 218 ± 31 | N/A | 995 ± 93 | 189 ± 5 | 124 ± 17 | 218 ± 31 | 91 ± 18 | N/A | 265 ± 48 | 203 ± 266 |

TABLE 5-continued

Production of 19-SMG, steviol-1,3-bioside, 1,2-stevioside, 1,3-stevioside, and compounds 4.26, 4.33, 5.24, 5.25, 6.1, 6.23, 7.2, and 7.5 (in AUC/OD$_{600}$) using UGT74G1 SSL candidates.

| | 19-SMG | steviol-1,3-bioside | 1,2-stevioside | 1,3-stevioside (RebG) | # 4.26 | # 4.33 | # 5.24 | # 5.25 | # 6.1 | # 6.23 | # 7.2 | # 7.5 |
|---|---|---|---|---|---|---|---|---|---|---|---|---|
| Var_7 | 149 ± 22 | 31 ± 36 | 220 ± 37 | 13 ± 27 | 632 ± 79 | 313 ± 42 | 92 ± 9 | 220 ± 37 | 145 ± 39 | 162 ± 109 | 371 ± 28 | 233 ± 157 |

TABLE 6

Production of glycosylated ent-kaurenoic acid and glycosylated ent-kaurenols (in AUC/OD$_{600}$) using UGT74G1 SSL candidates.

| | KA2.7 | KA3.1 | KA3.2 | KL3.1 & KL3.2 |
|---|---|---|---|---|
| UGT74G1 | 1,026 ± 102 | 213 ± 31 | 4,338 ± 374 | 1,003 ± 93 |
| Var_1 | 1,190 ± 96 | 235 ± 33 | 6,991 ± 625 | 603 ± 90 |
| Var_2 | 1,014 ± 102 | 227 ± 28 | 6,055 ± 309 | 807 ± 95 |
| Var_3 | N/A | N/A | 24 ± 29 | 776 ± 96 |
| Var_4 | 871 ± 45 | 203 ± 38 | 5,710 ± 376 | 795 ± 46 |
| Var_5 | 1,070 ± 60 | 216 ± 51 | 6,413 ± 553 | 794 ± 64 |
| Var_6 | 947 ± 54 | 215 ± 58 | 5,415 ± 241 | 724 ± 76 |
| Var_7 | 312 ± 33 | 99 ± 19 | 2,314 ± 233 | 811 ± 74 |

As shown in Tables 4-6, expression of UGT74G1 SSL candidates results in increases and/or decreases in accumulation of one or more glycosides of steviol, ent-kaurenol, and/or ent-kaurenoic acid, providing an altered distribution of glycoside accumulation relative to a host expressing wild-type UGT74G1 polypeptide.

Example 4. Evaluation of UGT74G1-b-UGT85C2 and UGT85C2-b-UGT74G1 Chimeric Enzymes UGT85C2 is expressed in the Stevia plant and catalyzes, among other reactions, the conversion of steviol to steviol-13-O-glycoside (13-SMG), which is further converted to rubusoside by UGT74G1. UGT74G1, however, may be localized in yeast cells differently than other steviol glycoside pathway enzymes, resulting in reduced apparent activity.

Fusion constructs of a GENEART™ codon optimized version of UGT74G1 (SEQ ID NO:1, SEQ ID NO:4) and UGT85C2 (SEQ ID NO:149, SEQ ID NO:7) were generated by adding a C-terminal SpeI restriction site and two thymines to the leading UGT to obtain a "KLVK" (SEQ ID NO:191) tetra-peptide between the two UGTs. Fusion constructs were also generated by inserting the sequence encoding the above-mentioned tetra-peptide upstream of a sequence encoding the penta-peptide RASST, yielding the linker sequence "RASSTKLVK" (SEQ ID NO:150). Three such constructs, Chim_1-Chim_3, were generated (See, Table 7).

Fusion constructs of a GENEART™ codon optimized version of UGT74G1 (SEQ ID NO:1, SEQ ID NO:4) and UGT85C2 (SEQ ID NO:149, SEQ ID NO:7) were additionally generated by PCR stitching to directly fuse the N- and C-terminals of the two UGTs, or by flexibly linking the N- and C-terminals of the two UGTs with one or three repeats of the penta-peptide "GGGGS" (SEQ ID NO:192), as described in Chen et al., "Fusion protein linkers: Property, design and functionality," Advanced Drug Delivery Reviews 65(0):1257-69 (2013). Six such constructs, Chim_4-Chim_9 were generated (See, Table 7). Fusion constructs were expressed and analyzed according to Example 3.

TABLE 7

UGT74G1/UGT85C2 Chimeric Enzymes

| Name | Fusion Construct | SEQ ID NO |
|---|---|---|
| Chim_1 | UGT85C2 - RASSTKLVK - UGT74G1 | 131, 132 |
| Chim_2 | UGT74G1 - RASSTKLVK - UGT85C2 | 133, 134 |
| Chim_3 | UGT74G1 - KLVK - UGT85C2 | 135, 136 |
| Chim_4 | UGT85C2 - (GGGGS)$_3$ - UGT74G1 | 137, 138 |
| Chim_5 | UGT85C2 - (GGGGS)$_1$ - UGT74G1 | 139, 140 |
| Chim_6 | UGT85C2 - UGT74G1 | 141, 142 |
| Chim_7 | UGT74G1 - (GGGGS)$_3$ - UGT85C2 | 143, 144 |
| Chim_8 | UGT74G1 - (GGGGS)$_1$ - UGT85C2 | 145, 146 |
| Chim_9 | UGT74G1 - UGT85C2 | 147, 148 |

Concentration (μM) values or area-under-the-curve (AUC) values for LC-MS derived peaks corresponding to several steviol glycosides, ent-kaurenols (KL), and ent-kaurenoic acids (KA) were determined for each UGT74G1-b-UGT85C2 and UGT85C2-b-UGT74G1 chimeric enzyme. Results, normalized to cell OD$_{600}$ (μM/OD$_{600}$ or AUC/OD$_{600}$) are shown in Tables 8-10.

TABLE 8

Production of 13-SMG, steviol-1,2-bioside, RebB, RebA, RebE, RebD, and RebM (in μM/OD$_{600}$) using UGT74G1/UGT85C2 chimeric enzymes.

| | 13-SMG | Steviol-1,2-bioside | Rubusoside | RebB | RebA | RebE | RebD | RebM |
|---|---|---|---|---|---|---|---|---|
| UGT74G1 | 1.05 ± 0.17 | 0.02 ± 0.01 | 0.01 ± 0.02 | 0.58 ± 0.06 | 0.62 ± 0.08 | N/A | 0.68 ± 0.10 | 1.81 ± 0.23 |
| Chim_1 | 1.75 ± 0.06 | 0.02 ± 0.00 | 0.02 ± 0.01 | 0.88 ± 0.04 | 0.69 ± 0.08 | N/A | 0.74 ± 0.06 | 1.95 ± 0.18 |
| Chim_2 | 1.64 ± 0.34 | 0.02 ± 0.00 | 0.01 ± 0.01 | 0.61 ± 0.21 | 0.34 ± 0.06 | N/A | 0.34 ± 0.08 | 0.94 ± 0.38 |
| Chim_3 | 2.93 ± 0.51 | 0.04 ± 0.02 | N/A | 1.56 ± 0.76 | 0.22 ± 0.07 | N/A | 0.22 ± 0.06 | 0.79 ± 0.28 |
| Chim_4 | 1.95 ± 0.19 | 0.02 ± 0.00 | 0.03 ± 0.00 | 1.01 ± 0.11 | 0.84 ± 0.10 | 0.01 ± 0.01 | 0.94 ± 0.09 | 2.62 ± 0.23 |
| Chim_5 | 2.20 ± 0.20 | 0.03 ± 0.00 | 0.03 ± 0.00 | 1.05 ± 0.13 | 0.75 ± 0.06 | 0.01 ± 0.01 | 0.76 ± 0.07 | 2.29 ± 0.25 |
| Chim_6 | 2.44 ± 0.35 | 0.03 ± 0.00 | 0.03 ± 0.00 | 1.12 ± 0.14 | 0.70 ± 0.09 | N/A | 0.73 ± 0.09 | 2.21 ± 0.29 |

TABLE 8-continued

Production of 13-SMG, steviol-1,2-bioside, RebB, RebA, RebE, RebD, and RebM (in μM/OD$_{600}$) using UGT74G1/UGT85C2 chimeric enzymes.

| | 13-SMG | Steviol-1,2-bioside | Rubusoside | RebB | RebA | RebE | RebD | RebM |
|---|---|---|---|---|---|---|---|---|
| Chim_7 | 4.16 ± 0.86 | 0.04 ± 0.02 | 0.01 ± 0.01 | 1.62 ± 0.48 | 0.29 ± 0.29 | N/A | 0.30 ± 0.28 | 1.01 ± 0.91 |
| Chim_8 | 4.90 ± 0.75 | 0.04 ± 0.01 | 0.01 ± 0.02 | 1.88 ± 0.26 | 0.37 ± 0.23 | N/A | 0.43 ± 0.24 | 1.55 ± 0.85 |
| Chim_9 | 1.27 ± 0.24 | 0.01 ± 0.01 | 0.03 ± 0.01 | 0.82 ± 0.14 | 0.89 ± 0.09 | 0.00 ± 0.00 | 0.32 ± 0.03 | 1.07 ± 0.13 |

TABLE 9

Production of 19-SMG, steviol-1,3-bioside, 1,2-stevioside, 1,3-stevioside, and compounds 4.26, 4.33, 5.24, 5.25, 6.1, 6.23, 7.2, and 7.5 (in AUC/OD$_{600}$) using UGT74G1/UGT85C2 chimeric enzymes.

| | 19-SMG | steviol-1,3-bioside | 1,2-stevioside | 1,3-stevioside (RebG) | # 4.26 | # 4.33 | # 5.24 | # 5.25 | # 6.1 | # 6.23 | # 7.2 | # 7.5 |
|---|---|---|---|---|---|---|---|---|---|---|---|---|
| UGT74G1 | 420 ± 50 | N/A | 257 ± 56 | N/A | 509 ± 66 | 164 ± 41 | 145 ± 13 | 130 ± 87 | 91 ± 11 | N/A | 210 ± 53 | 231 ± 284 |
| Chim_1 | 78 ± 21 | 21 ± 42 | 311 ± 51 | N/A | 444 ± 101 | 217 ± 20 | 40 ± 79 | 177 ± 39 | 99 ± 17 | N/A | 236 ± 16 | 220 ± 271 |
| Chim_2 | 59 ± 46 | 20 ± 39 | 181 ± 59 | N/A | 219 ± 121 | 129 ± 88 | 63 ± 73 | 38 ± 77 | 41 ± 49 | N/A | 118 ± 79 | 71 ± 142 |
| Chim_3 | N/A | 61 ± 81 | 97 ± 34 | N/A | 189 ± 108 | 341 ± 181 | N/A | N/A | N/A | N/A | 62 ± 72 | N/A |
| Chim_4 | 109 ± 18 | 55 ± 38 | 389 ± 38 | 38 ± 44 | 675 ± 86 | 253 ± 51 | 113 ± 83 | 191 ± 25 | 149 ± 31 | 166 ± 115 | 368 ± 81 | 63 ± 127 |
| Chim_5 | 128 ± 20 | 47 ± 54 | 345 ± 47 | 17 ± 35 | 683 ± 199 | 250 ± 27 | 171 ± 53 | 199 ± 25 | 69 ± 48 | 53 ± 106 | 264 ± 50 | 68 ± 135 |
| Chim_6 | 82 ± 25 | 58 ± 42 | 291 ± 64 | 17 ± 33 | 563 ± 87 | 285 ± 70 | 109 ± 83 | 232 ± 34 | 77 ± 12 | 46 ± 92 | 276 ± 53 | 211 ± 262 |
| Chim_7 | 31 ± 63 | 94 ± 67 | 113 ± 128 | N/A | 336 ± 191 | 337 ± 129 | 36 ± 71 | 54 ± 107 | 26 ± 52 | N/A | 115 ± 156 | N/A |
| Chim_8 | 25 ± 50 | 55 ± 37 | 166 ± 67 | 15 ± 30 | 367 ± 125 | 427 ± 55 | 76 ± 89 | 93 ± 118 | 16 ± 32 | 58 ± 116 | 215 ± 152 | 89 ± 178 |
| Chim_9 | 1,031 ± 145 | 52 ± 37 | 383 ± 67 | 20 ± 39 | 761 ± 108 | 190 ± 27 | 867 ± 81 | 3583 ± 316 | 24 ± 28 | 116 ± 135 | 101 ± 7 | 51 ± 102 |

TABLE 10

Production of glycosylated ent-kaurenoic acid and glycosylated ent-kaurenols (in AUC/OD$_{600}$) using UGT74G1/UGT85C2 chimeric enzymes.

| | KA2.7 | KA3.1 | KA3.2 | KL2.8 | KL3.1 & KL3.2 |
|---|---|---|---|---|---|
| UGT74G1 | 1,026 ± 102 | 213 ± 31 | 4,338 ± 374 | N/A | 1,003 ± 93 |
| Chim_1 | 471 ± 132 | 103 ± 23 | 1,880 ± 680 | N/A | 1,118 ± 121 |
| Chim_2 | 338 ± 35 | 24 ± 49 | 970 ± 392 | N/A | 661 ± 282 |
| Chim_3 | N/A | N/A | 321 ± 202 | 35 ± 71 | 882 ± 461 |
| Chim_4 | 485 ± 81 | 112 ± 26 | 2,444 ± 401 | N/A | 1,133 ± 83 |
| Chim_5 | 601 ± 64 | 127 ± 36 | 3,088 ± 736 | N/A | 1,100 ± 30 |
| Chim_6 | 425 ± 31 | 114 ± 17 | 2,095 ± 443 | N/A | 1,002 ± 206 |
| Chim_7 | 84 ± 168 | 23 ± 46 | 495 ± 675 | 66 ± 77 | 1,190 ± 783 |
| Chim_8 | 137 ± 159 | 28 ± 56 | 748 ± 667 | N/A | 1,192 ± 343 |
| Chim_9 | 785 ± 82 | 164 ± 27 | 4,798 ± 899 | 245 ± 11 | 4,240 ± 306 |

As shown in Tables 8-10, expression of UGT74G1/UGT85C2 chimeric enzymes results in increases and/or decreases in accumulation of one or more glycosides of steviol, ent-kaurenol, and/or ent-kaurenoic acid, providing an altered distribution of glycoside accumulation relative to a host expressing wild-type UGT74G1 and/or UGT85C2.

Example 5. Expression of Tagged UGT74G1 Polypeptides

A steviol glycoside-producing *S. cerevisiae* strain as described in Example 2. further comprising and expressing a recombinant gene encoding a KO polypeptide (SEQ ID NO:117, SEQ ID NO:64) and a recombinant gene encoding a KAH polypeptide (SEQ ID NO:96, SEQ ID NO:97), was further engineered to disrupt expression of native UGT74G1 polypeptide.

The native UGT74G1-disrupted strain was engineered to comprise and express a tagged UGT74G1 protein. The tags were disulfide oxidoreductase (DsbA: SEQ ID NO:156, SEQ ID NO:152), maltose binding protein (MBP; SEQ ID NO:157, SEQ ID NO:153), N-utilization substance (NusA; SEQ ID NO:158, SEQ ID NO:154), small ubiquitin-like modifier (SUMO; SEQ ID NO:159, SEQ ID NO:155). Without being bound by theory, the results suggest that such tags play a role in increasing solubility of UGTs such as UGT74G1, which may result in increased accumulation of steviol glycosides, including RebD and RebM. See FIGS. 7-14.

Example 6. Modulation of Substrate-Specificity of UGT74G1 (Continued)

UGT74G1 is expressed in the *Stevia* plant and catalyzes, among other reactions, the conversion of 13-SMG to rubusoside. Because UGT74G1 demonstrates substrate promiscuity and 13-SMG accumulates in steviol glycoside-producing hosts, alternate genes for catalyzing 13-SMG to rubusoside were identified.

A homology model of UGT74G1 was generated from the crystal structure of UGT78K6 (PDB:2C1Z), using Rebaudioside B (RebB) as a substrate for docking analysis. RebB was chosen because it is the largest steviol glycoside UGT74G1 is known to have activity on. The homology model was generated using the modeling suite in the Molecular Operating Environment (MOE) software (Chemical Computing Group).

Twenty-seven amino acids were determined to be within 4.5 Å of RebB in the homology model. Results are shown in Table 2 (see Example 3, above). A UGT74G1 site saturation library (SSL) screen of the 27 amino acids was prepared using GENEART™ (Thermo Fisher Scientific) in a GENEART™ codon optimized version of UGT74G1 (SEQ ID NO:1, SEQ ID NO:4). Histidine 23 (i.e., His23) is fully conserved and is believed to be catalytically active, and as such was not included in the site saturation library. In addition to the variants expressed in Example 3, above, 1056 site saturated variants were expressed with the p416-GPD vector in a steviol glycoside producing *S. cerevisiae* strain as described in Example 2, further comprising and expressing a recombinant gene encoding a KO polypeptide (SEQ ID NO:117, SEQ ID NO:64) and a recombinant gene encoding a KAH polypeptide (SEQ ID NO:96, SEQ ID NO:97), and further engineered to disrupt expression of native UGT74G1 polypeptide. The strains were incubated in 1 mL synthetic complete (SC) uracil dropout media at 30° C. for five days, shaking at 400 rpm. 50 µL of each culture was transferred into 50 µL DMSO, incubated at 80° C. for 10 minutes, and centrifuged at 3220 g for 5 minutes. 15 µL of the resulting supernatant was then transferred to 105 µL 50% DMSO for LC-MS analysis.

5 candidates (Var_8-Var_12) were selected from the SSL variants and sequenced (See, Table 11).

TABLE 11

Sequenced UGT74G1 Variants

| Name | Nucleotide Changes | Amino Acid Changes | SEQ ID NO |
|---|---|---|---|
| Var_8 | G241T<br>C242G<br>T243G | A81W | 160, 161 |
| Var_9 | C550A<br>A551C<br>C552T | H184T | 162, 163 |
| Var_10 | A858T | K286N | 164, 165 |
| Var_11 | A235G<br>T236A<br>G237A | M79E | 166, 167 |
| Var_12 | A857C<br>A858T | K286T | 168, 169 |

Concentration (µM) values or area-under-the-curve (AUC) values for LC-MS derived peaks corresponding to several glycosides of steviol and ent-kaurenoic acids (KA) were determined for each *S. cerevisiae* strain expressing an UGT74G1 SSL candidate. Results, normalized to cell $OD_{600}$ (µM/OD or AUC/OD) are shown in Tables 12-14.

TABLE 12

Production of 13-SMG, 19-SMG, steviol-1,2-bioside, rubusoside, RebG, RebB, RebA, RebD and RebM (in $\mu M/OD_{600}$) using UGT74G1 SSL candidates.

|  | 13-SMG | 19-SMG | Steviol-1,2-bioside | Rubusoside | 1,3-stevioside (RebG) | RebB | RebA | RebD | RebM |
|---|---|---|---|---|---|---|---|---|---|
| UGT74G1 | 1.10 ± 0.22 | 0.09 ± 0.01 | 0.04 ± 0.00 | 0.06 ± 0.01 | 0.02 ± 0.01 | 0.67 ± 0.04 | 0.64 ± 0.03 | 0.56 ± 0.04 | 1.98 ± 0.23 |
| Var_8 | 1.57 ± 0.17 | 0.06 ± 0.00 | 0.04 ± 0.00 | 0.07 ± 0.00 | 0.03 ± 0.00 | 0.88 ± 0.07 | 0.71 ± 0.05 | 0.64 ± 0.04 | 2.32 ± 0.16 |
| Var_9 | 1.74 ± 0.28 | 0.08 ± 0.01 | 0.05 ± 0.00 | 0.08 ± 0.01 | 0.03 ± 0.00 | 0.97 ± 0.10 | 0.73 ± 0.06 | 0.68 ± 0.05 | 2.32 ± 0.28 |
| Var_10 | 1.40 ± 0.08 | 0.09 ± 0.00 | 0.04 ± 0.00 | 0.07 ± 0.01 | 0.03 ± 0.00 | 0.78 ± 0.04 | 0.65 ± 0.04 | 0.54 ± 0.05 | 2.29 ± 0.26 |
| Var_11 | 1.24 ± 0.17 | 0.09 ± 0.01 | 0.04 ± 0.00 | 0.07 ± 0.01 | 0.02 ± 0.01 | 0.68 ± 0.06 | 0.63 ± 0.08 | 0.60 ± 0.08 | 2.10 ± 0.24 |
| Var_12 | 0.71 ± 0.27 | 0.07 ± 0.01 | 0.02 ± 0.02 | 0.04 ± 0.03 | 0.01 ± 0.01 | 0.44 ± 0.12 | 0.46 ± 0.10 | 0.40 ± 0.13 | 1.26 ± 0.47 |

TABLE 13

Production of steviol-1,3-bioside, 1,2-stevioside, and compounds 4.26, 4.33, 5.24, 5.25, 6.1, 6.23, 7.2, and 7.5 (in $AUC/OD_{600}$) using UGT74G1 SSL candidates.

|  | steviol-1,3-bioside | 1,2-stevioside | # 4.26 | # 4.33 | # 5.24 | # 5.25 | # 6.1 | # 6.23 | # 7.2 | # 7.5 |
|---|---|---|---|---|---|---|---|---|---|---|
| UGT74G1 | 0 ± 0 | 336 ± 36 | 1273 ± 306 | 157 ± 58 | 638 ± 89 | 409 ± 24 | 32 ± 55 | 0 ± 0 | 126 ± 218 | 472 ± 216 |
| Var_8 | 0 ± 0 | 340 ± 20 | 1074 ± 142 | 218 ± 21 | 545 ± 36 | 444 ± 18 | 80 ± 77 | 0 ± 0 | 356 ± 28 | 0 ± 0 |
| Var_9 | 0 ± 0 | 387 ± 15 | 1353 ± 328 | 181 ± 41 | 692 ± 173 | 436 ± 13 | 136 ± 22 | 0 ± 0 | 402 ± 19 | 645 ± 559 |
| Var_10 | 0 ± 0 | 310 ± 17 | 1720 ± 201 | 67 ± 116 | 638 ± 107 | 416 ± 67 | 59 ± 51 | 86 ± 149 | 127 ± 219 | 0 ± 0 |
| Var_11 | 0 ± 0 | 316 ± 93 | 1815 ± 190 | 204 ± 36 | 687 ± 134 | 372 ± 84 | 93 ± 81 | 0 ± 0 | 269 ± 237 | 327 ± 566 |
| Var_12 | 0 ± 0 | 243 ± 59 | 836 ± 448 | 115 ± 108 | 386 ± 339 | 221 ± 191 | 60 ± 52 | 0 ± 0 | 0 ± 0 | 234 ± 405 |

TABLE 14

Production of glycosylated ent-kaurenoic acid (in AUC/OD$_{600}$) using UGT74G1 SSL candidates.

|  | KA2.7 | KA3.1 | KA3.2 |
|---|---|---|---|
| UGT74G1 | 1184 ± 75 | 246 ± 34 | 6195 ± 585 |
| Var_8 | 597 ± 51 | 44 ± 76 | 3351 ± 445 |
| Var_9 | 856 ± 108 | 152 ± 133 | 4618 ± 709 |
| Var_10 | 1304 ± 33 | 293 ± 32 | 7407 ± 867 |
| Var_11 | 1685 ± 141 | 285 ± 21 | 8029 ± 1079 |
| Var_12 | 833 ± 157 | 135 ± 117 | 3836 ± 1664 |

As shown in Tables 12-14, expression of UGT74G1 SSL candidates results in increases and/or decreases in accumulation of one or more glycosides of steviol, ent-kaurenol, and/or ent-kaurenoic acid, providing an altered distribution of glycoside accumulation relative to a host expressing wild-type UGT74G1 polypeptide.

Example 7: Expression of Tagged UGT74G1 Polypeptides (Strain 1)

A steviol glycoside-producing *S. cerevisiae* strain as described in Example 2, comprising and expressing a recombinant gene encoding a KO polypeptide (SEQ ID NO:117, SEQ ID NO:64) and a recombinant gene encoding a KAH polypeptide (SEQ ID NO:96, SEQ ID NO:97), was further engineered to disrupt expression of native UGT74G1 polypeptide.

The strain was further transformed to comprise and express tagged UGT74G1 polypeptide candidates operably linked to a TEF1 promoter (SEQ ID NO:170) and a ADH1 terminator (SEQ ID NO:171). Tagged constructs of a GENEART™ codon optimized version of UGT74G1 (SEQ ID NO:1, SEQ ID NO:4) and the tags of interest at the N terminal part of the protein, including disulfide oxidoreductase (DsbA: SEQ ID NO:156, SEQ ID NO:152), maltose binding protein (MBP; SEQ ID NO:157, SEQ ID NO:153), N-utilization substance (NusA; SEQ ID NO:158, SEQ ID NO:154) and small ubiquitin-like modifier (SUMO; SEQ ID NO:159, SEQ ID NO:155) were generated by PCR-stitching both fragments with a soluble linker (SEQ ID NO:172, SEQ ID NO:151). See Table 15.

TABLE 15

Tagged UGTG74G1 Polypeptides

| Name | Construct | SEQ ID NO |
|---|---|---|
| Chim_10 | DsbA-EGKSSGSGSESKST-UGT74 | 173, 174 |
| Chim_11 | MBP-EGKSSGSGSESKST-UGT74 | 175, 176 |
| Chim_12 | NusA-EGKSSGSGSESKST-UGT74 | 177, 178 |
| Chim_13 | SUMO-EGKSSGSGSESKST-UGT74 | 179, 180 |

Transformants were selected on antibiotic plates and presence of the construct was verified by PCR.

Single colonies of transformed strains were grown in 500 μL of buffered Delft medium in a in a Duetz 96-deepwell plate system for one day at 30° C. C in Kuhner ISF-1-W Incubator, shaking at 280 rpm. 50 μL of the cell culture from each well was then transferred to a new Duetz 96-deepwell plate system containing 450 μL of of buffered Delft medium. The deepwell plates were then grown for 4 days at 30° C. in Kuhner ISF-1-W Incubator, shaking at 280 rpm before ready for LC-MS analysis. Samples for LC-MS analysis were prepared by extracting 100 μL of cell solution with 100 μL of DMSO, vortexing until mixed, and incubating at 80° C. for 10 minutes. The resultant extract was clarified by centrifugation at 10,000 g for 10 min. 20 μL of the supernatant was diluted with 140 μL of 50% (v/v) DMSO for LC-MS injection. LC-MS data was normalized to the OD$_{600}$ of a mixture of 100 μL of the cell solution and 100 μL of water, measured on an ENVISION® Multilabel Reader (PerkinElmer, Waltham, Mass.).

LC-MS analysis was performed according to Example 1. Results, of the average of 6 independent clones, are shown in Tables 16-18.

TABLE 16

Production of 13-SMG, 19-SMG, steviol-1,2-bioside, RebB, RebA, RebE, RebD, and RebM (in μM/OD$_{600}$) using tagged UGT74G1 polypeptides (SEQ ID NOs: 174, 176, 178, and 180) or WT UGT74G1 polypeptide (SEQ ID NO: 4).

|  | 13-SMG | 19-SMG | steviol-1,2-bioside | rubusoside | RebB | RebA | RebE | RebD | RebM |
|---|---|---|---|---|---|---|---|---|---|
| UGT74G1 | 4.99 ± 5.90 | 0.50 ± 0.46 | 0.08 ± 0.02 | 0.56 ± 0.51 | 2.38 ± 1.59 | 3.65 ± 1.47 | 0.02 ± 0.02 | 2.27 ± 0.19 | 6.88 ± 1.08 |
| Chim_10 | 7.49 ± 1.43 | 0.08 ± 0.06 | 0.05 ± 0.02 | 0.21 ± 0.07 | 1.17 ± 0.37 | 3.32 ± 0.67 | 0.02 ± 0.02 | 3.23 ± 0.52 | 13.37 ± 2.30 |
| Chim_11 | 7.59 ± 1.52 | 0.12 ± 0.06 | 0.05 ± 0.01 | 0.38 ± 0.19 | 1.53 ± 0.31 | 4.54 ± 1.11 | 0.00 ± 0.01 | 3.03 ± 0.89 | 10.53 ± 2.90 |
| Chim_12 | 5.46 ± 1.76 | 0.28 ± 0.11 | 0.06 ± 0.01 | 0.43 ± 0.13 | 1.64 ± 0.36 | 4.85 ± 0.73 | 0.01 ± 0.02 | 3.41 ± 0.88 | 10.40 ± 2.79 |
| Chim_13 | 7.71 ± 2.54 | 0.27 ± 0.06 | 0.09 ± 0.03 | 0.50 ± 0.22 | 2.47 ± 0.92 | 4.92 ± 0.55 | 0.00 ± 0.00 | 3.00 ± 0.81 | 8.16 ± 2.26 |

TABLE 17

Production of steviol-1,3-bioside, 1,2-stevioside, 1,3-stevioside, and compounds 4.26, 4.33, 5.24, 4.25, 6.1, 6.23, 7.1, and 7.5 (in AUC/OD$_{600}$) using tagged UGT74G1 polypeptides (SEQ ID NOs: 174, 176, 178, and 180) or WT UGT74G1 polypeptide (SEQ ID NO: 4).

|  | steviol-1,3-bioside | 1,2-stevioside | 1,3-stevioside (RebG) | # 4.26 | # 4.33 | # 5.24 | # 5.25 | # 6.1 | # 6.23 | # 7.1 | # 7.5 |
|---|---|---|---|---|---|---|---|---|---|---|---|
| UGT74G1 | 267 ± 243 | 3980 ± 1604 | 606 ± 171 | 13189 ± 598 | 295 ± 589 | 1444 ± 633 | 2130 ± 797 | 201 ± 232 | 490 ± 150 | 1076 ± 364 | 1093 ± 1089 |
| Chim_10 | 86 ± 141 | 3671 ± 701 | 399 ± 85 | 8842 ± 2610 | 0 ± 0 | 2187 ± 1246 | 3307 ± 731 | 801 ± 126 | 1468 ± 152 | 3097 ± 686 | 1134 ± 1378 |
| Chim_11 | 220 ± 171 | 4705 ± 1277 | 473 ± 125 | 7308 ± 2416 | 73 ± 178 | 1372 ± 461 | 3058 ± 698 | 587 ± 474 | 1388 ± 495 | 2246 ± 1413 | 1087 ± 746 |

TABLE 17-continued

Production of steviol-1,3-bioside, 1,2-stevioside, 1,3-stevioside, and compounds 4.26, 4.33, 5.24, 4.25, 6.1, 6.23, 7.1, and 7.5 (in AUC/OD$_{600}$) using tagged UGT74G1 polypeptides (SEQ ID NOs: 174, 176, 178, and 180) or WT UGT74G1 polypeptide (SEQ ID NO: 4).

|  | steviol-1,3-bioside | 1,2-stevioside | 1,3-stevioside (RebG) | # 4.26 | # 4.33 | # 5.24 | # 5.25 | # 6.1 | # 6.23 | # 7.1 | # 7.5 |
|---|---|---|---|---|---|---|---|---|---|---|---|
| Chim_12 | 157 ± 275 | 5102 ± 660 | 398 ± 213 | 8223 ± 1272 | 0 ± 0 | 1546 ± 903 | 3082 ± 1063 | 642 ± 384 | 1192 ± 380 | 2276 ± 1198 | 491 ± 555 |
| Chim_13 | 453 ± 404 | 5134 ± 491 | 374 ± 218 | 7081 ± 1351 | 174 ± 427 | 614 ± 373 | 2307 ± 395 | 420 ± 333 | 1013 ± 387 | 1423 ± 678 | 432 ± 478 |

TABLE 18

Production of glycosylated ent-kaurenoic acid (in AUC/OD$_{600}$) using tagged UGT74G1 polypeptides (SEQ ID NOs: 174, 176, 178, and 180) or WT UGT74G1 polypeptide (SEQ ID NO: 4).

|  | KA2.7 | KA3.1 | KA3.2 |
|---|---|---|---|
| UGT74G1 | 6537 ± 2312 | 1008 ± 555 | 30440 ± 11785 |
| Chim_10 | 1702 ± 425 | 713 ± 211 | 12809 ± 3137 |
| Chim_11 | 1228 ± 405 | 379 ± 336 | 8641 ± 3274 |
| Chim_12 | 2561 ± 1340 | 738 ± 562 | 15009 ± 7935 |
| Chim_13 | 2018 ± 456 | 383 ± 230 | 9503 ± 3167 |

As shown in Tables 16-18, expression of tagged UGT74G1 fusion candidates in yeast cause in general a decrease of KA+2Glc, KA+3Glc isomer2, KA-3Glc isomer1, RebB and Rubusoside. Concomitantly, increasing accumulation of higher molecular weight steviol glycosides is seen, indicating a better conversion of steviol glycosides and other intermediates towards at least RebD and RebM by tagged UGT74G1 fusion candidates compared to the wild-type UGT74G1 enzyme. Without being bound by theory, the results suggest that that the tags play a role in increasing solubility of polypeptides, such as UGT74G1, and therefore a better activity of it which may result in increased accumulation of steviol glycosides, including RebD and RebM. See FIGS. 7-14.

Example 8. Expression of Tagged UGT74G1 Polypeptides (Strain 2)

A steviol glycoside-producing *S. cerevisiae* strain as described in Example 2 further engineered to comprise and express a recombinant gene encoding a KO polypeptide (SEQ ID NO:117, SEQ ID NO:64) and a recombinant gene encoding a KAH polypeptide (SEQ ID NO:96, SEQ ID NO:97), was transformed with two independent integrative vectors comprising a tagged UGT74G1 polypeptide (as described in Example 7) operably linked to a TEF1 promoter (SEQ ID NO:170) and an ADH1 terminator (SEQ ID NO:171). Transformants were selected on antibiotic plates and presence of the construct was verified by PCR.

Single colonies of transformed strains were grown in 500 µL of buffered Delft medium in a in a Duetz 96-deepwell plate system for one day at 30° C. C in Kuhner ISF-1-W Incubator, shaking at 280 rpm. 50 µL of the cell culture from each well was then transferred to a new Duetz 96-deepwell plate system containing 450 µL of of buffered Delft medium. The deepwell plates were then grown for 4 days at 30° C. in Kuhner ISF-1-W Incubator, shaking at 280 rpm before ready for LC-MS analysis. Samples for LC-MS analysis were prepared by extracting 100 µL of cell solution with 100 µL of DMSO, vortexing until mixed, and incubating at 80° C. for 10 minutes. The resultant extract was clarified by centrifugation at 10,000 g for 10 min. 20 µL of the supernatant was diluted with 140 µL of 50% (v/v) DMSO for LC-MS injection. LC-MS data was normalized to the OD$_{600}$ of a mixture of 100 µL of the cell solution and 100 µL of water, measured on an ENVISION® Multilabel Reader (PerkinElmer, Waltham, Mass.).

Figure 10:
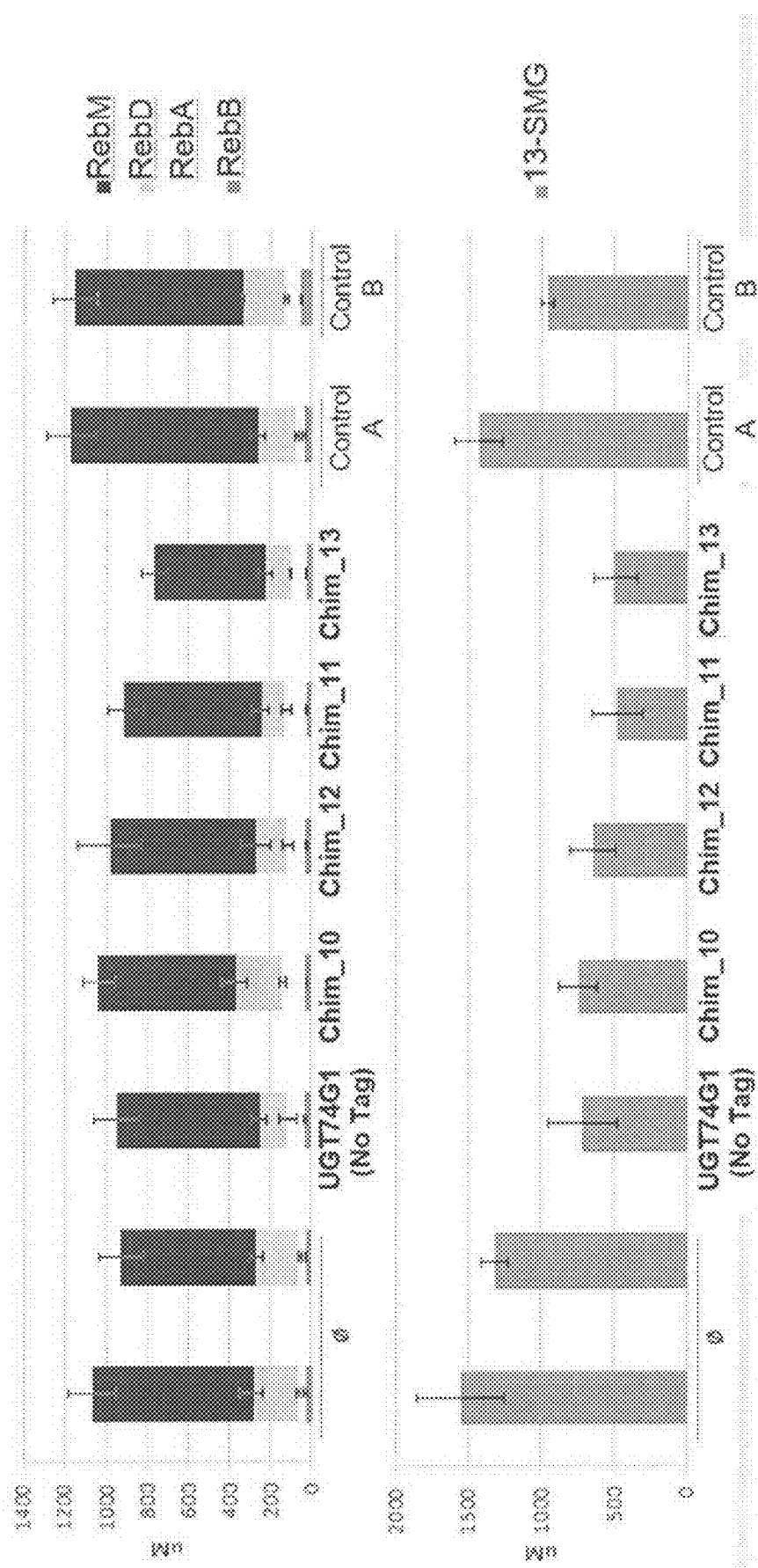
FIG. 10 shows accumulation of 13-SMG, RebA, RebB, RebD, and RebM by steviol glycoside-producing *S. cerevisiae* strains expressing tagged UGT74G1 polypeptides (Strain 2). See Example 8. Legend: Ø are control strains (control A, see the description of FIG. 7, above) transformed with an empty plasmid. Control B represents a typical steviol glycoside-producing strain and is herein included as reference. Each bar represents an average of 6 independent clones. For each variant (for each bar) of the top graph, the portions of the bar correspond to, from top to bottom, RebM, RebD, RebA, and RebB accumulation.
Figure 11:
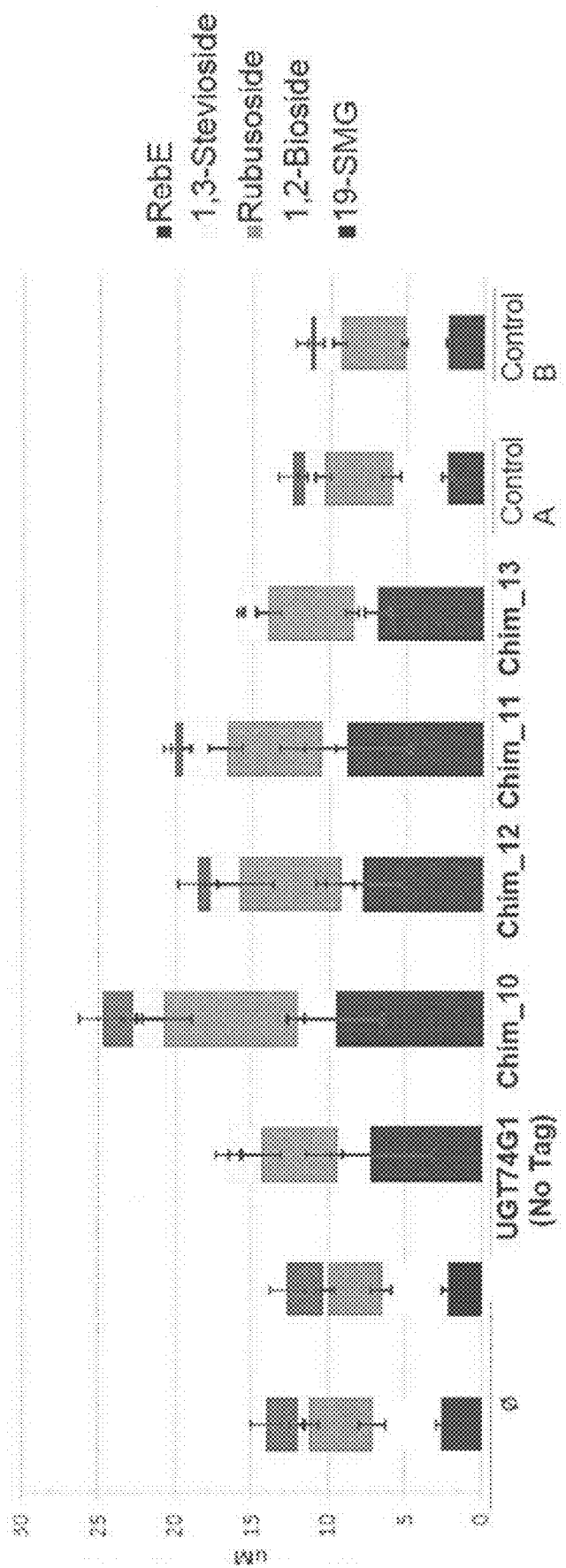
FIG. 11 shows accumulation of RebE, 1,3-stevioside, rubusoside, 1,2-bioside, and 19-SMG by steviol glycoside-producing *S. cerevisiae* strains expressing tagged UGT74G1 polypeptides (Strain 2). See Example 8. For legend, see description of FIG. 10. For each variant (for each bar), the portions of the bar correspond to, from top to bottom, RebE, 1,3-stevioside, rubusoside, 1,2-bioside, and 19-SMG accumulation.
Figure 12:
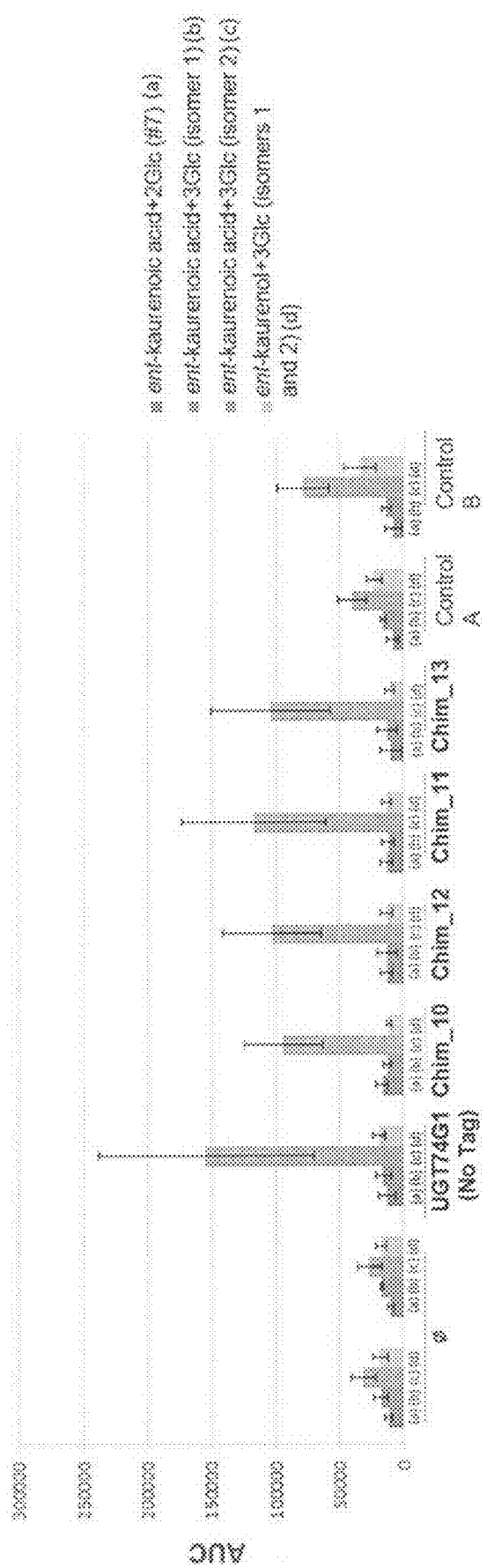
FIG. 12 shows accumulation of glycosylated ent-kaurenoic acid and glycosylated ent-kaurenol by steviol glycoside-producing *S. cerevisiae* strains expressing tagged UGT74G1 polypeptides (Strain 2). See Example 8. For legend, see description of FIG. 10. For each variant (for each set of bars), the bars correspond to, from left to right, ent-kaurenoic acid+2Glc (#7), ent-kaurenoic acid+3Glc (isomer 1), ent-kaurenoic acid+3Glc (isomer 2), ent-kaurenol+2Glc (#8), and ent-kaurenol+3Glc (isomers 1 and 2) accumulation.

LC-MS analysis was performed according to Example 1. Results of the average of 6 clones for each constructs are shown in FIGS. 10 to 12.

Expression of solubility tagged UGT74G1 fusion candidates in a steviol glycosides producing strain cause a decreased accumulation of all UGT74G1 dependant substrates: KA+2Glc (#7), KA+3Glc isomer2 and KA-3Glc isomer1 and 13-SMG. Without being bound by theory, the results suggest that expression of tagged UGT74G1 having improved solubility increases accumulation of one or more glycosides of steviol due to a better conversion of steviol precursors, such as ent-kaurenoic acid, to steviol, and a better conversion of steviol glycoside precursors, such as 13-SMG, toward RebD and RebM, as compared to wild-type UGT74G1 polypeptide.

Example 9. Expression of Tagged UGT74G1 Polypeptides (Strains 3 and 4)

A steviol glycoside-producing *S. cerevisiae* strain as described in Example 2, further engineered to comprise and express a recombinant gene encoding a KAH polypeptide (SEQ ID NO:96, SEQ ID NO:97) and a recombinant gene encoding a KO polypeptide (SEQ ID NO:117, SEQ ID NO:64), was transformed with vectors comprising an additional copy of the gene encoding a YNK1 polypeptide (SEQ ID NO:181, SEQ ID NO:182), operably linked to a pTEF1 promoter (SEQ ID NO:170) and a CYC1 terminator (SEQ ID NO:183), an additional copy of the gene encoding a PGM1 polypeptide (SEQ ID NO:184, SEQ ID NO:185), operably linked to a pTEF1 promoter (SEQ ID NO:170) and a CYC1 terminator (SEQ ID NO:183), an additional copy of the gene encoding a PGM2 polypeptide (SEQ ID NO:186, SEQ ID NO:187), operably linked to a pPGK1 promoter (SEQ ID NO:188) and a tADH1 terminator (SEQ ID NO:171), and an additional copy of the gene encoding a UGP1 polypeptide (SEQ ID NO:189, SEQ ID NO:190), operably linked to a pPGK1 promoter (SEQ ID NO:188) and a tADH1 terminator (SEQ ID NO:171). Two independents clones were transformed with a vector comprising a tagged UGT74G1 polypeptide (as described in Example 7) operably linked to a TEF1 promoter (SEQ ID NO:170) and an ADH1 terminator (SEQ ID NO:171). Transformants were selected on antibiotic plates and presence of the construct was verified by PCR.

Single colonies of transformed strains were grown in 500 µL of buffered Delft medium in a in a Duetz 96-deepwell plate system for one day at 30° C. C in Kuhner ISF-1-W Incubator, shaking at 280 rpm. 50 μL of the cell culture from each well was then transferred to a new Duetz 96-deepwell plate system containing 450 μL of of buffered Delft medium. The deepwell plates were then grown for 4 days at 30° C. in Kuhner ISF-1-W Incubator, shaking at 280 rpm before ready for LC-MS analysis. Samples for LC-MS analysis were prepared by extracting 100 μL of cell solution with 100 μL of DMSO, vortexing until mixed, and incubating at 80° C. for 10 minutes. The resultant extract was clarified by centrifugation at 10,000 g for 10 min. 20 μL of the supernatant was diluted with 140 μL of 50% (v/v) DMSO for LC-MS injection. LC-MS data was normalized to the $OD_{600}$ of a mixture of 100 μL of the cell solution and 100 μL of water, measured on an ENVISION® Multilabel Reader (PerkinElmer, Waltham, Mass.).

Figure 13:
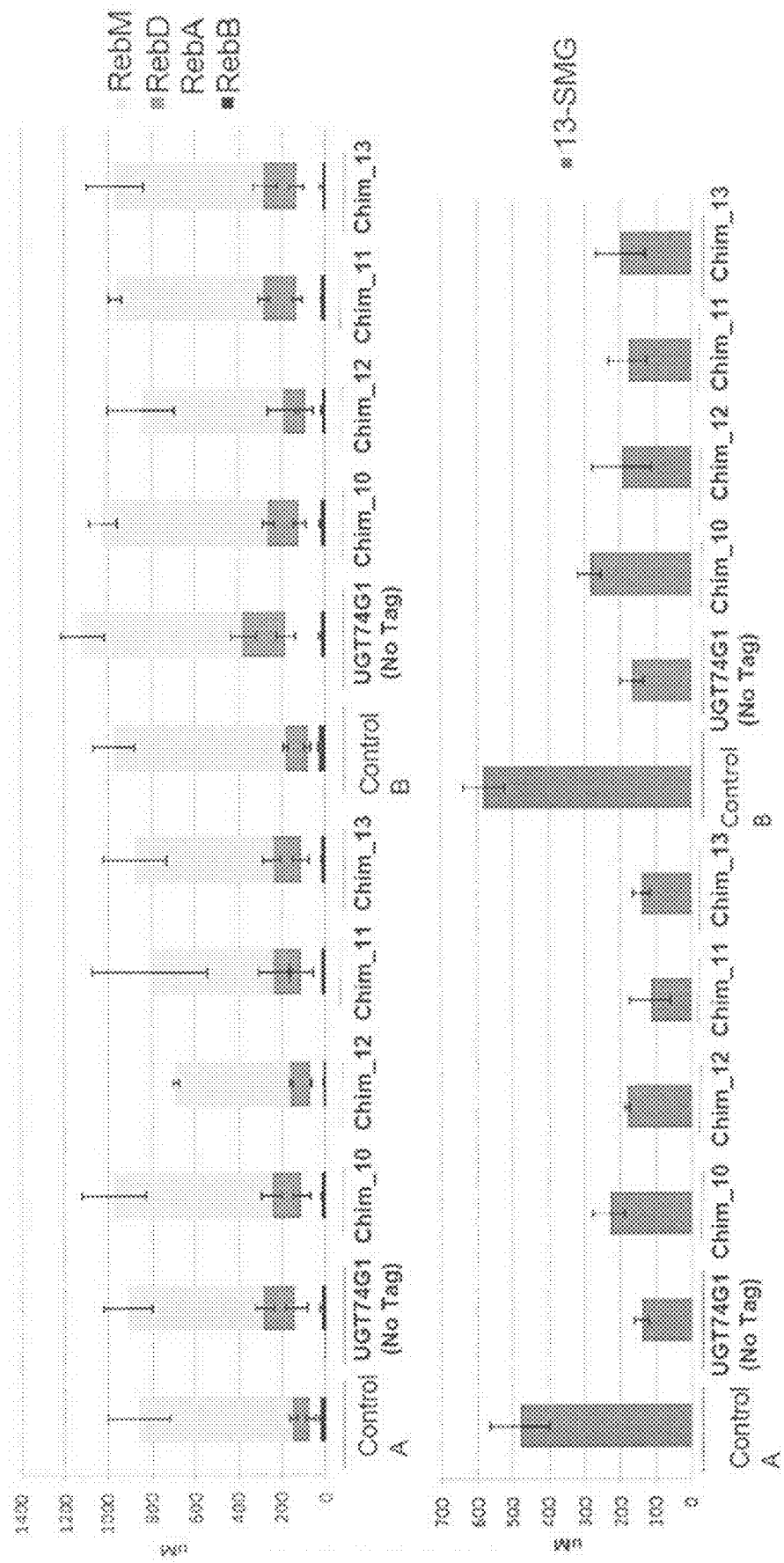
FIG. 13 shows accumulation of 13-SMG (bottom), and RebA, RebB, RebD, and RebM (top) by steviol glycoside-producing *S. cerevisiae* strains expressing tagged UGT74G1 polypeptides (Strains 3 and 4). See Example 9. Legend: Control A (see the description of FIG. 7, above) was transformed with an empty plasmid. Control B represents a typical steviol glycoside-producing strain and is herein included as reference. For each variant (for each bar) of the top graph, the portions of the bar correspond to, from top to bottom, RebM, RebD, RebA, and RebB accumulation.
Figure 14:
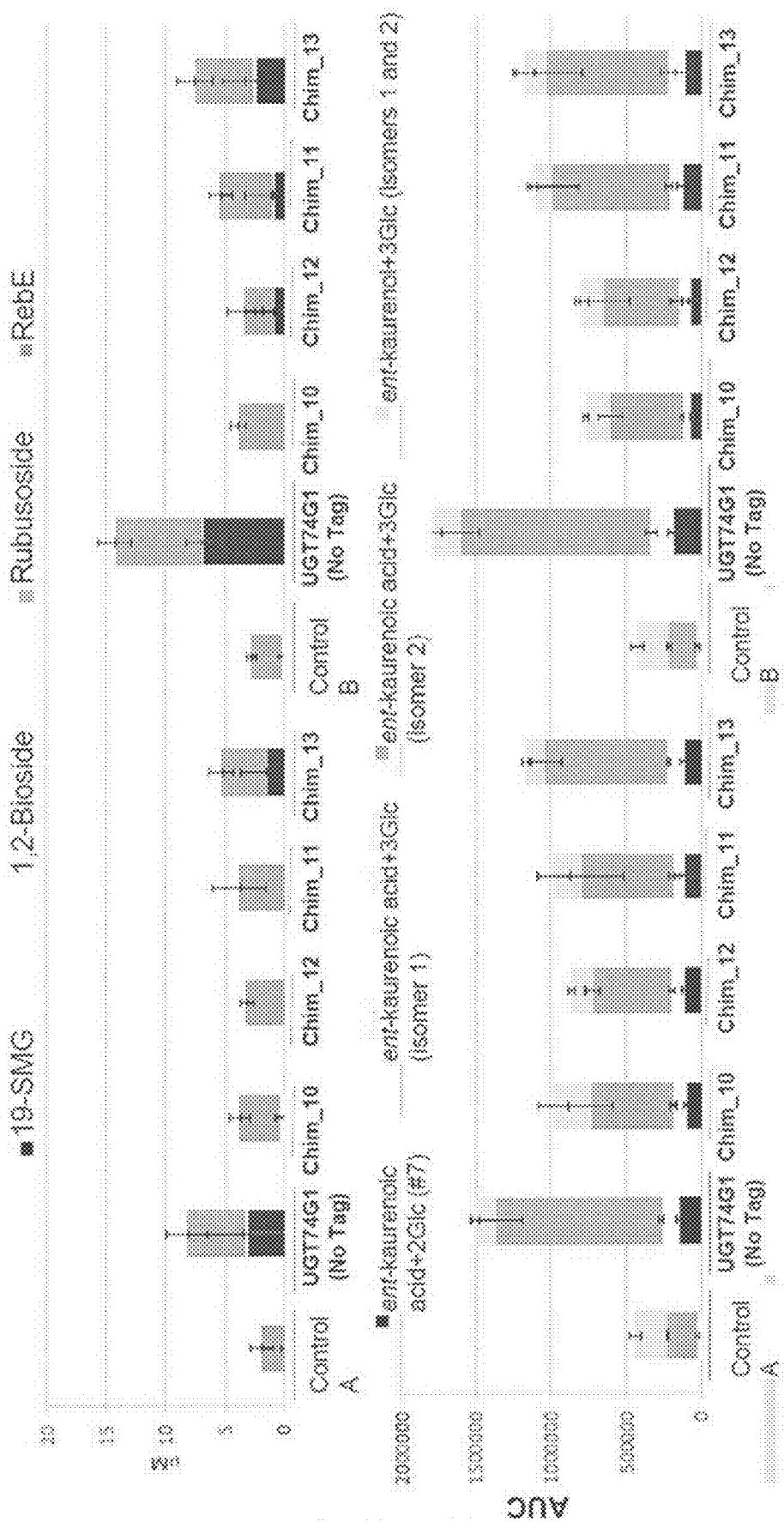
FIG. 14 (top graph) shows accumulation of 19-SMG, 1,2-bioside, Rubusoside and Reb E by steviol glycoside-producing *S. cerevisiae* strains expressing tagged UGT74G1 polypeptides (Strain 3 and 4). For each variant (for each bar) of the top graph, the portions of the bar correspond to, from bottom to top, 19-SMG, steviol-1,2-bioside, rubusoside, and RebE accumulation.
Figure 15A:
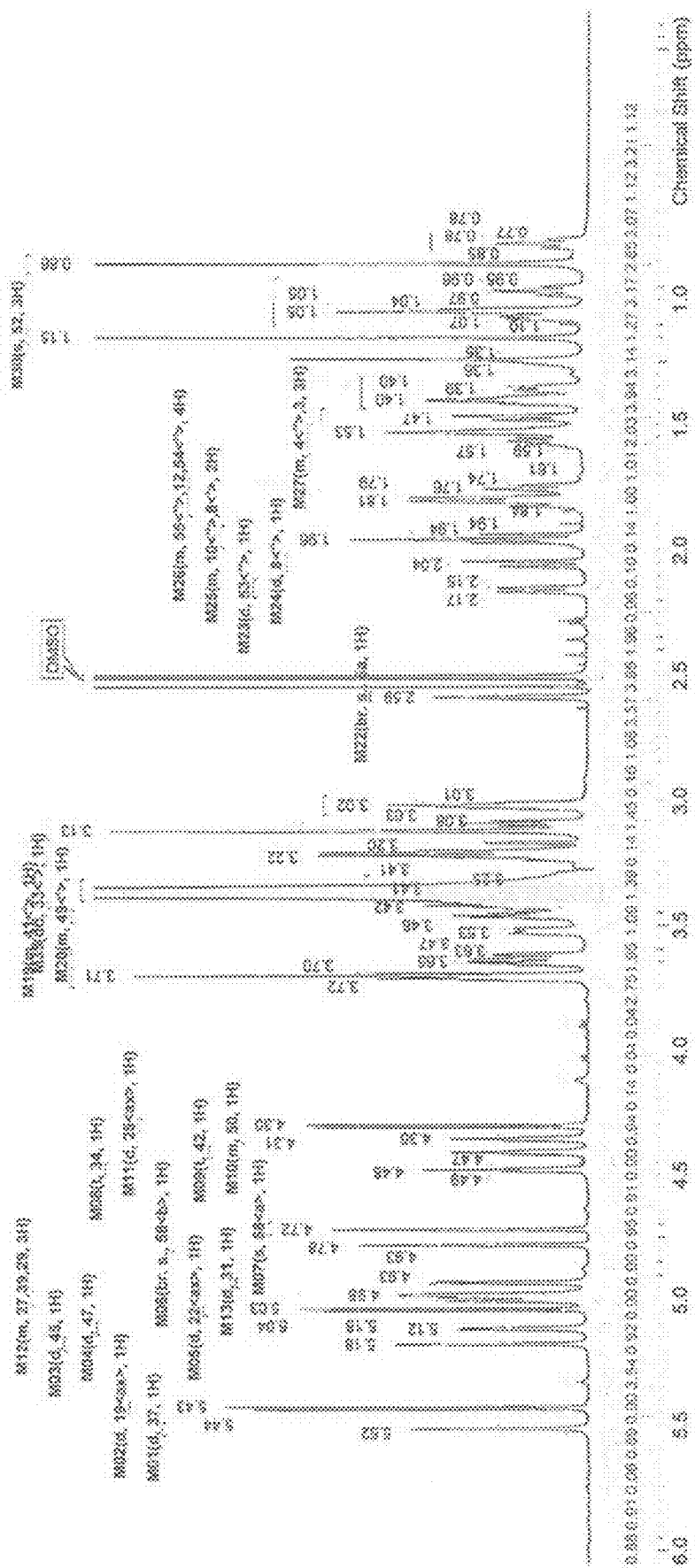
Figure 15C:
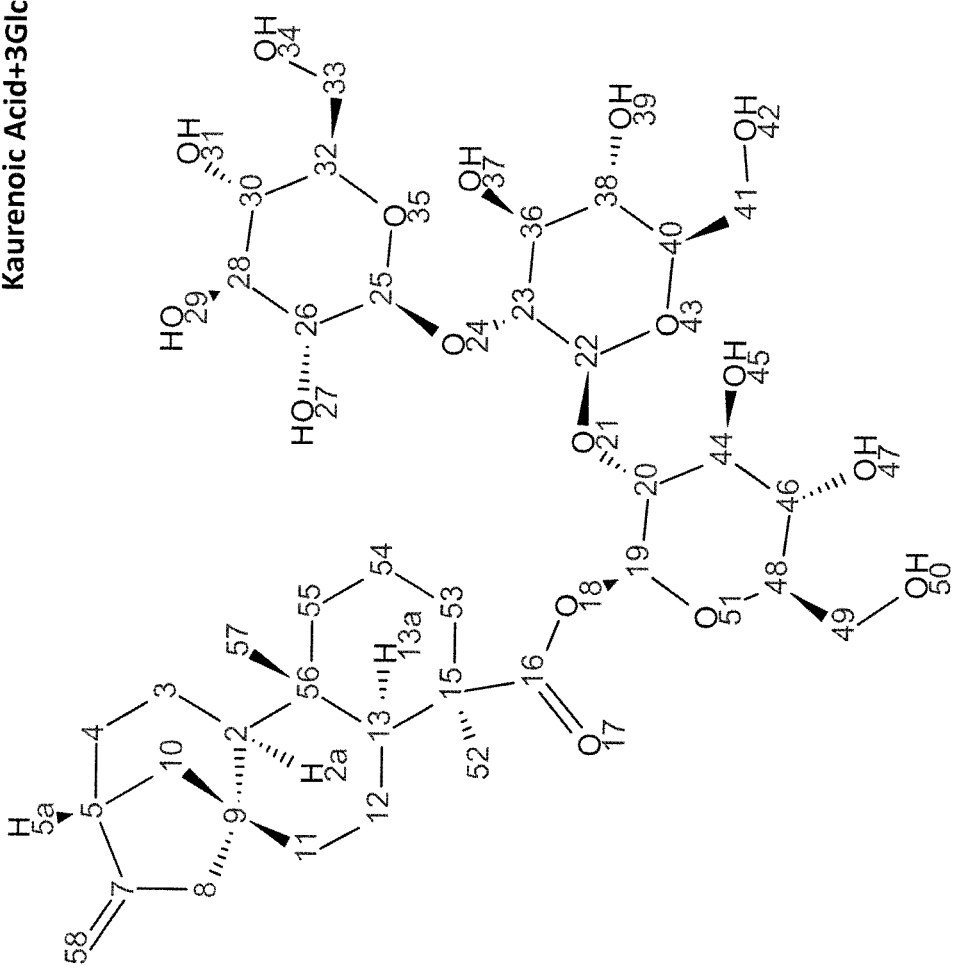
Figure 15F:
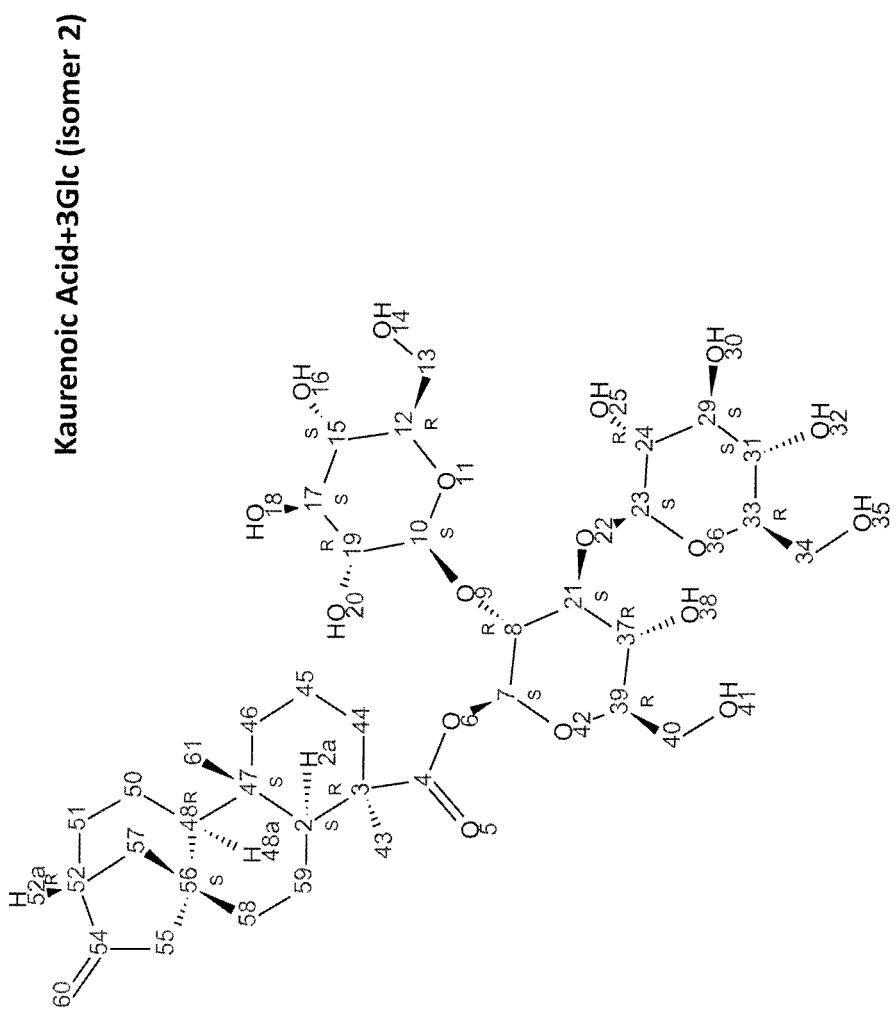
Figure 15G:
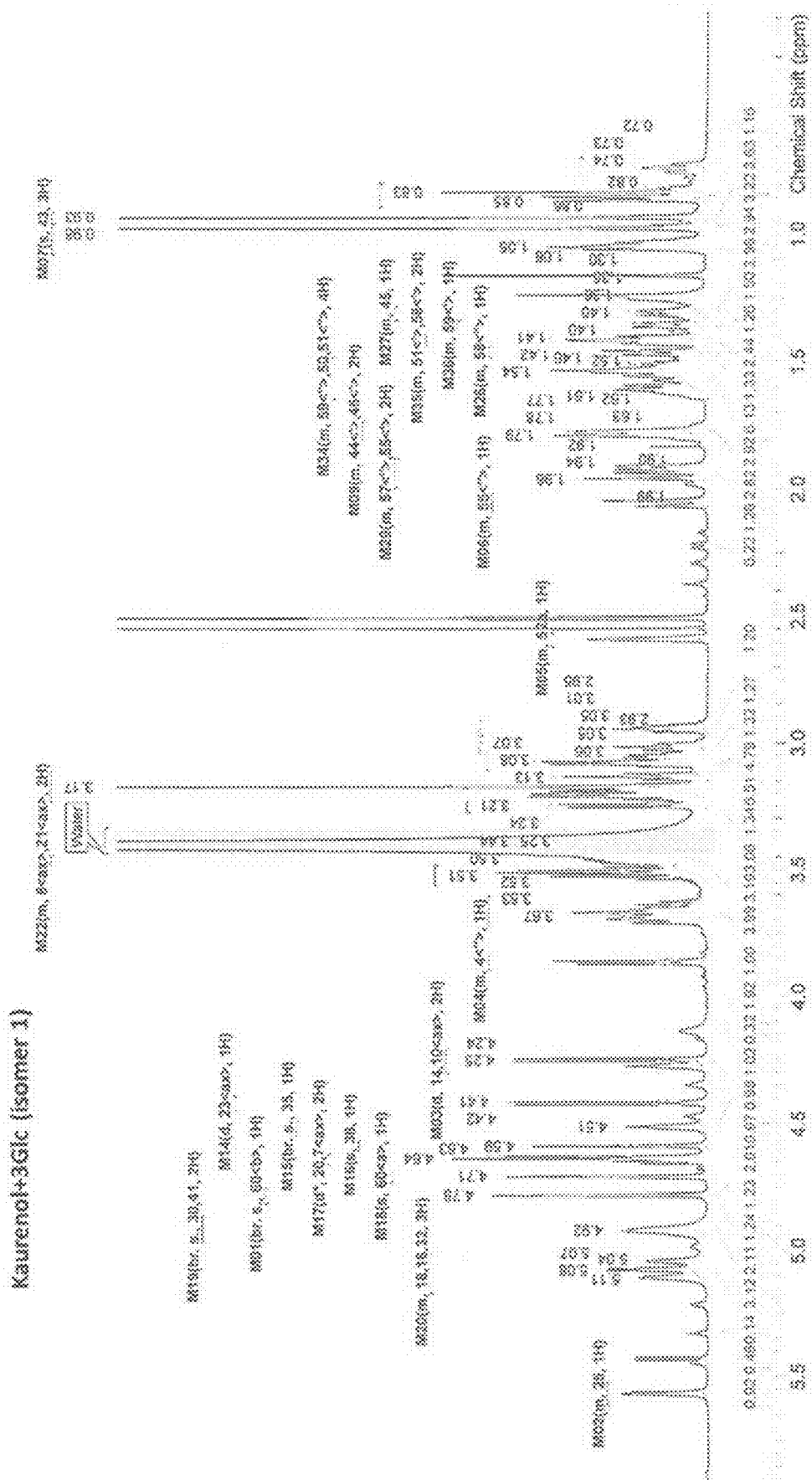
Figure 15H:
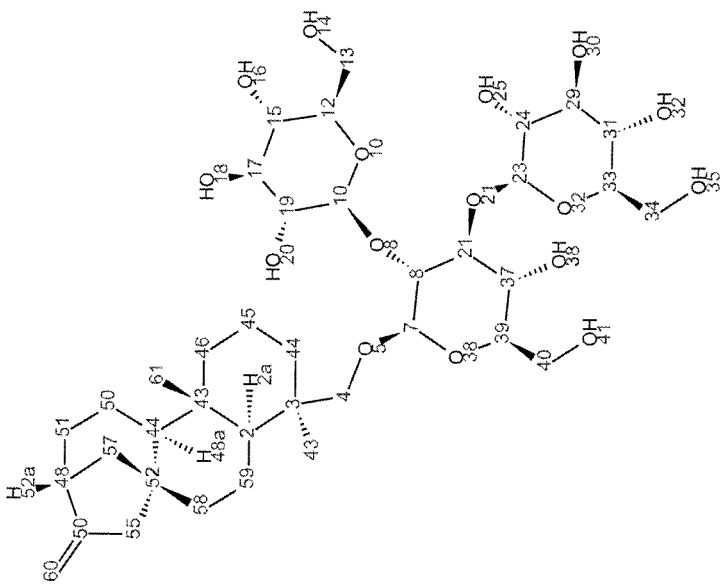
Figure 15J:
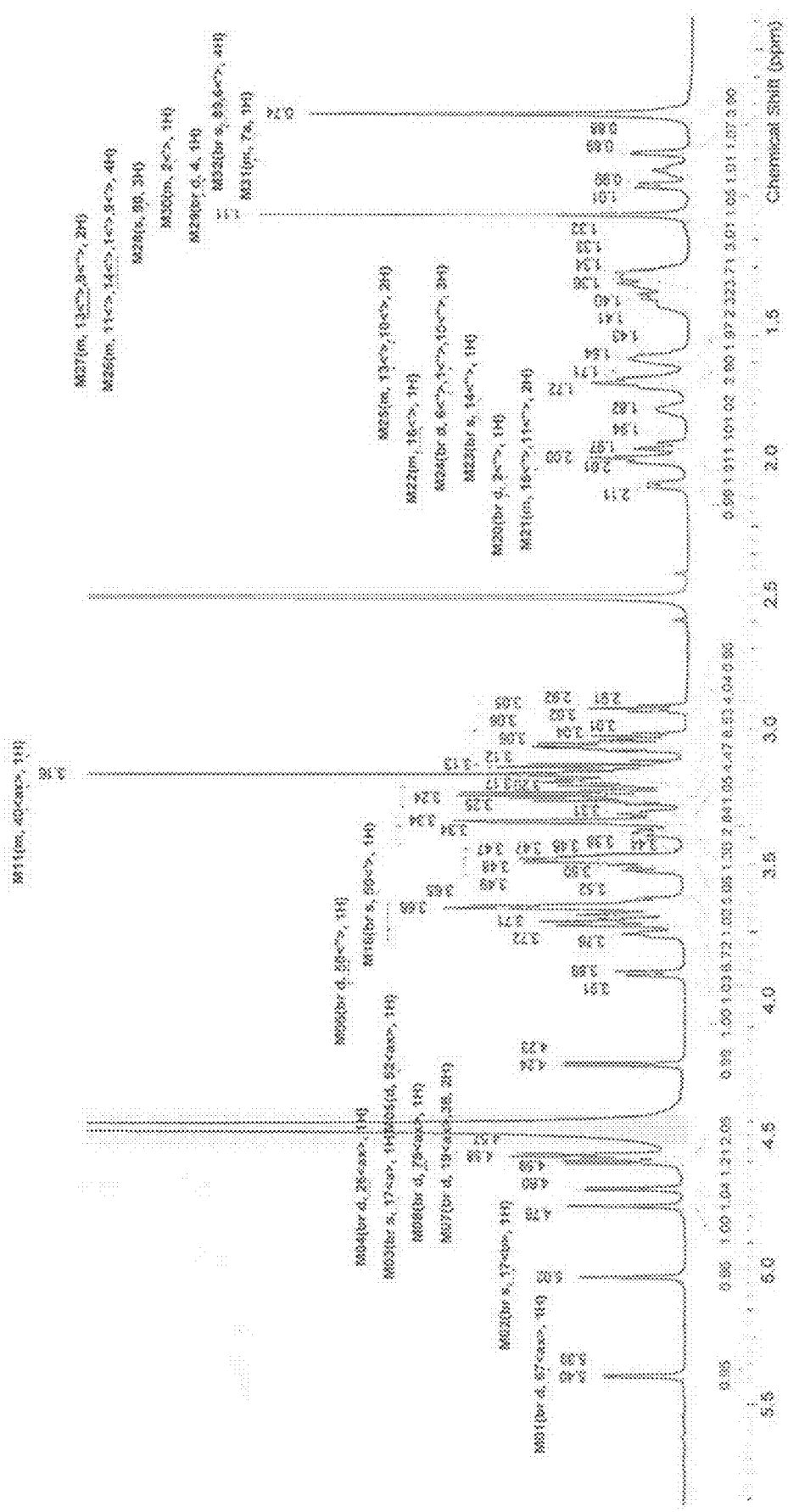
Figure 15L:
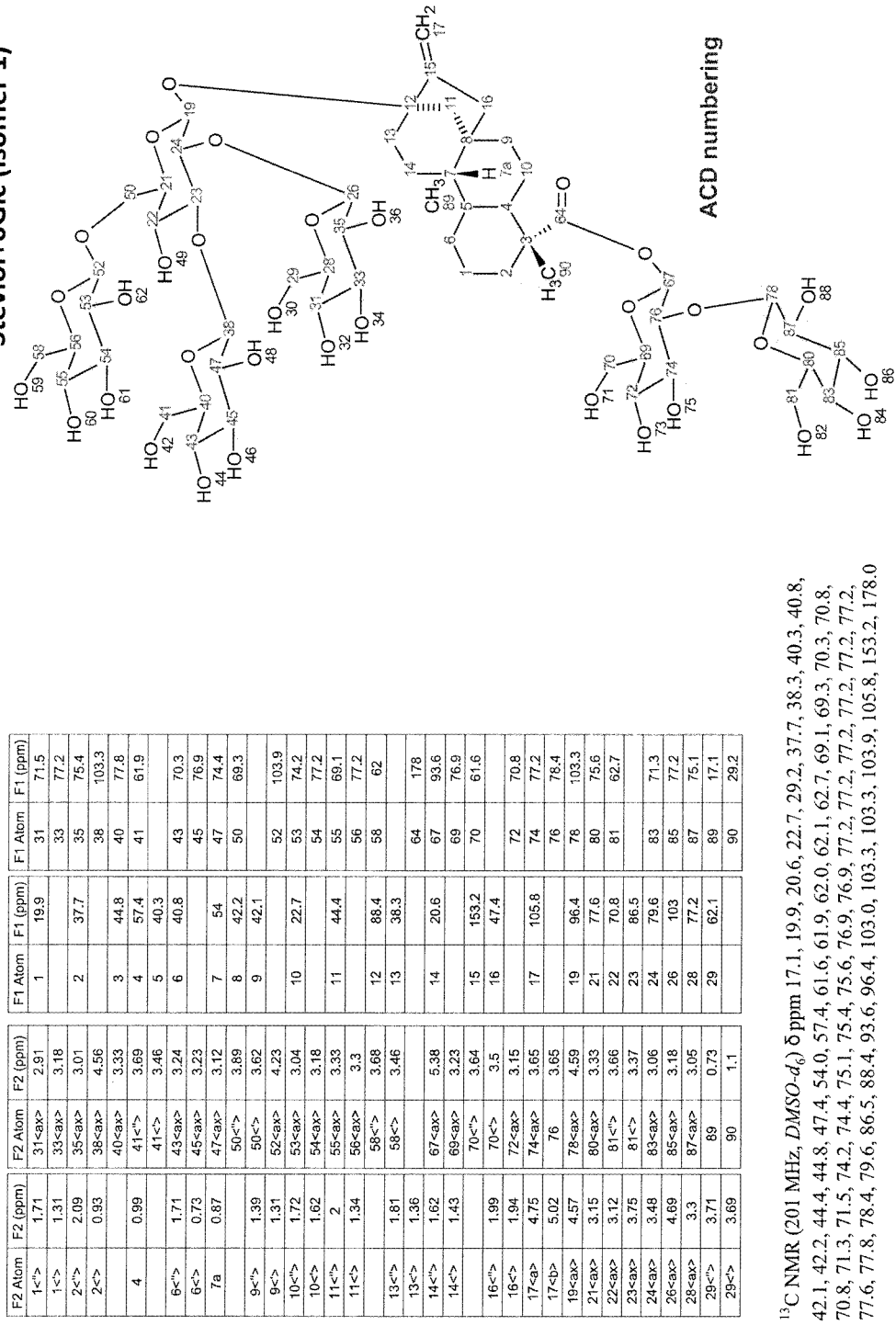
Figure 15M:
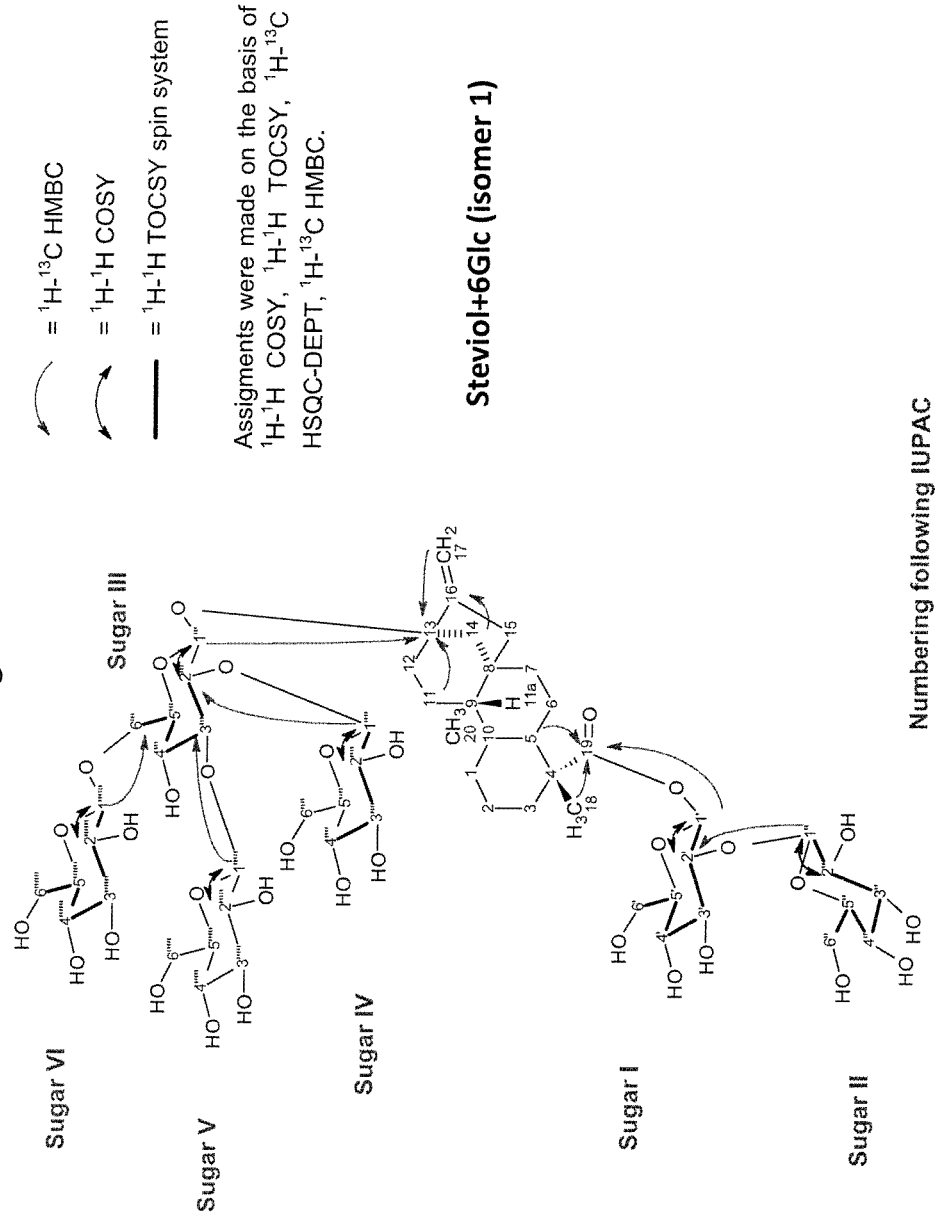
Figure 15N:
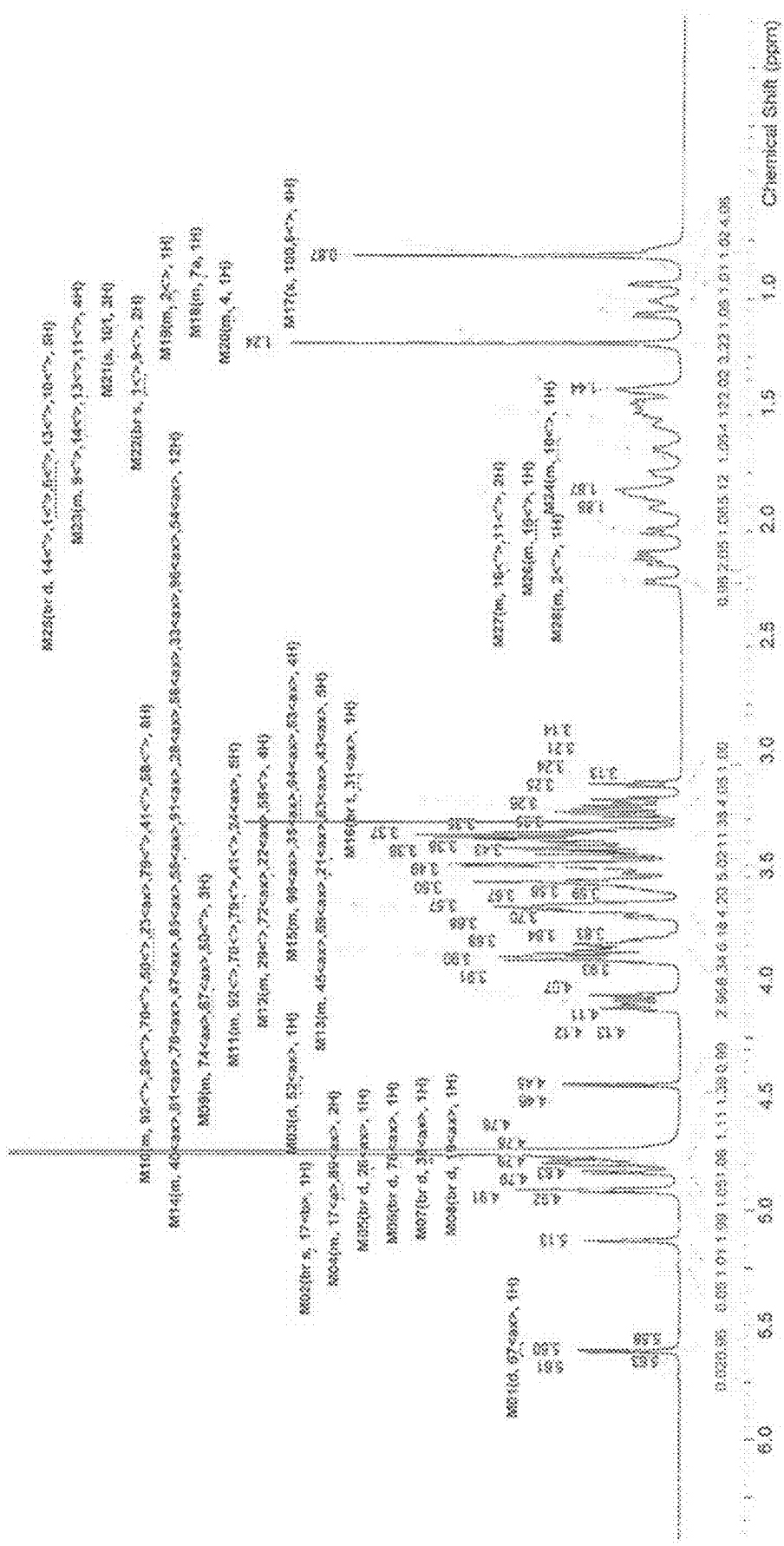
FIGS. 15N, 15O, 15P, and 15Q show a $^1$H NMR spectrum and $^1$H and $^{13}$C NMR chemical shifts (in ppm) for steviol+7Glc (isomer 2).
Figure 15O:
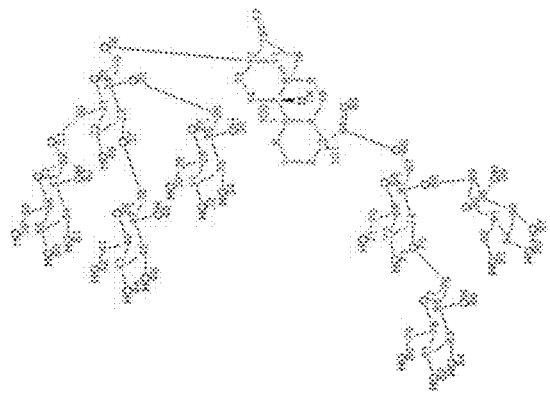
Figure 15P:
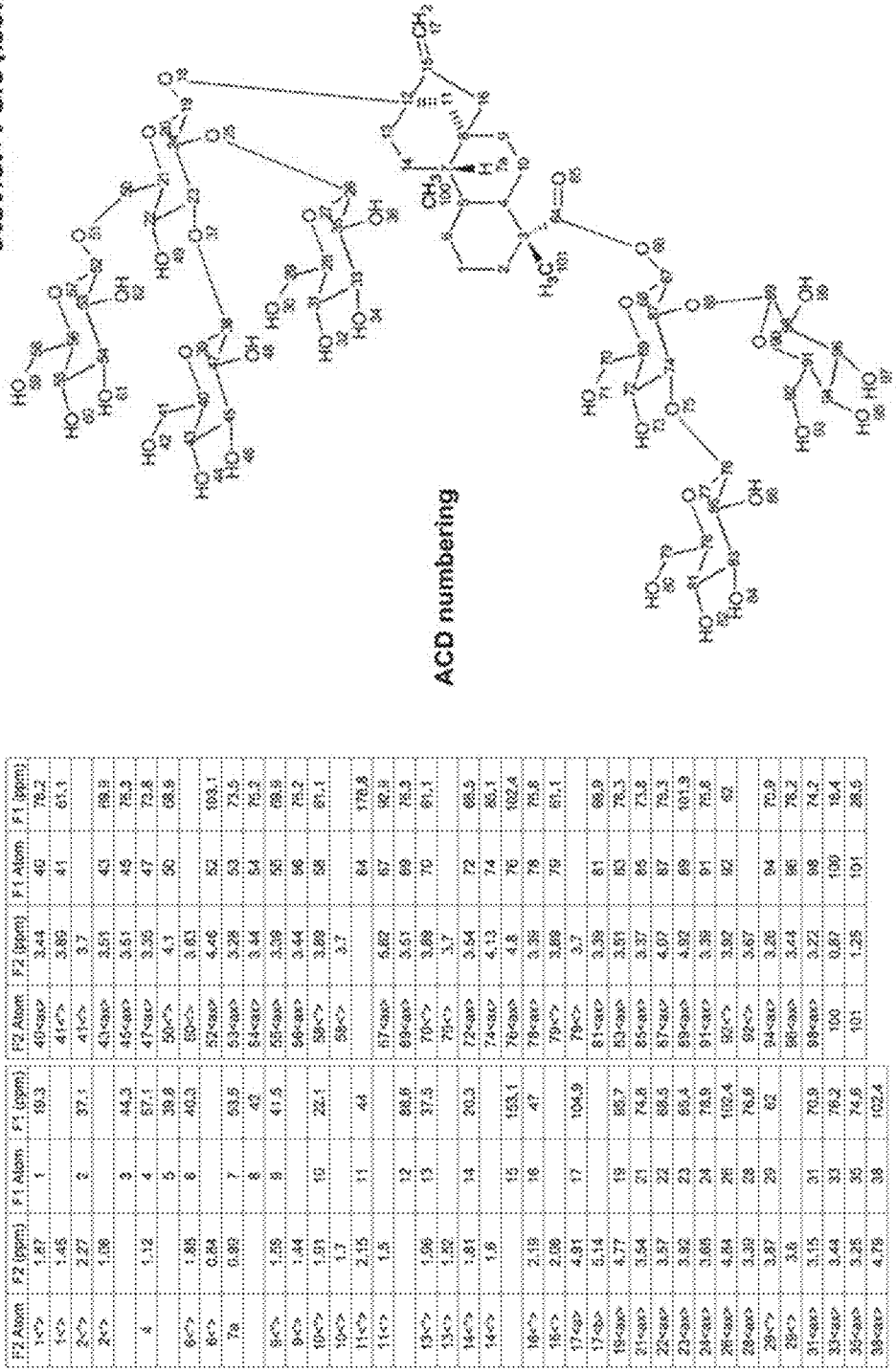
Figure 15Q:
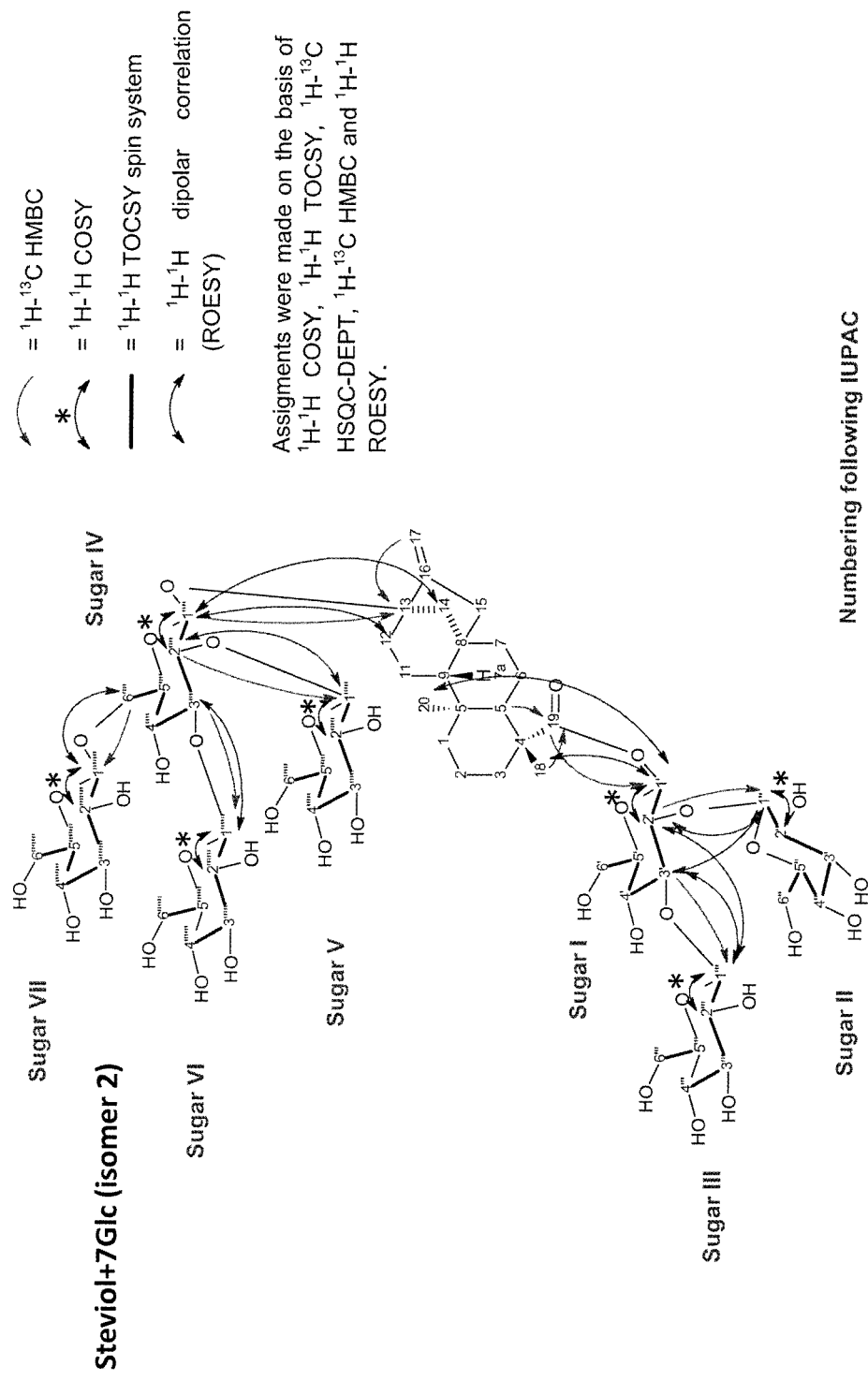
Figure 15R:
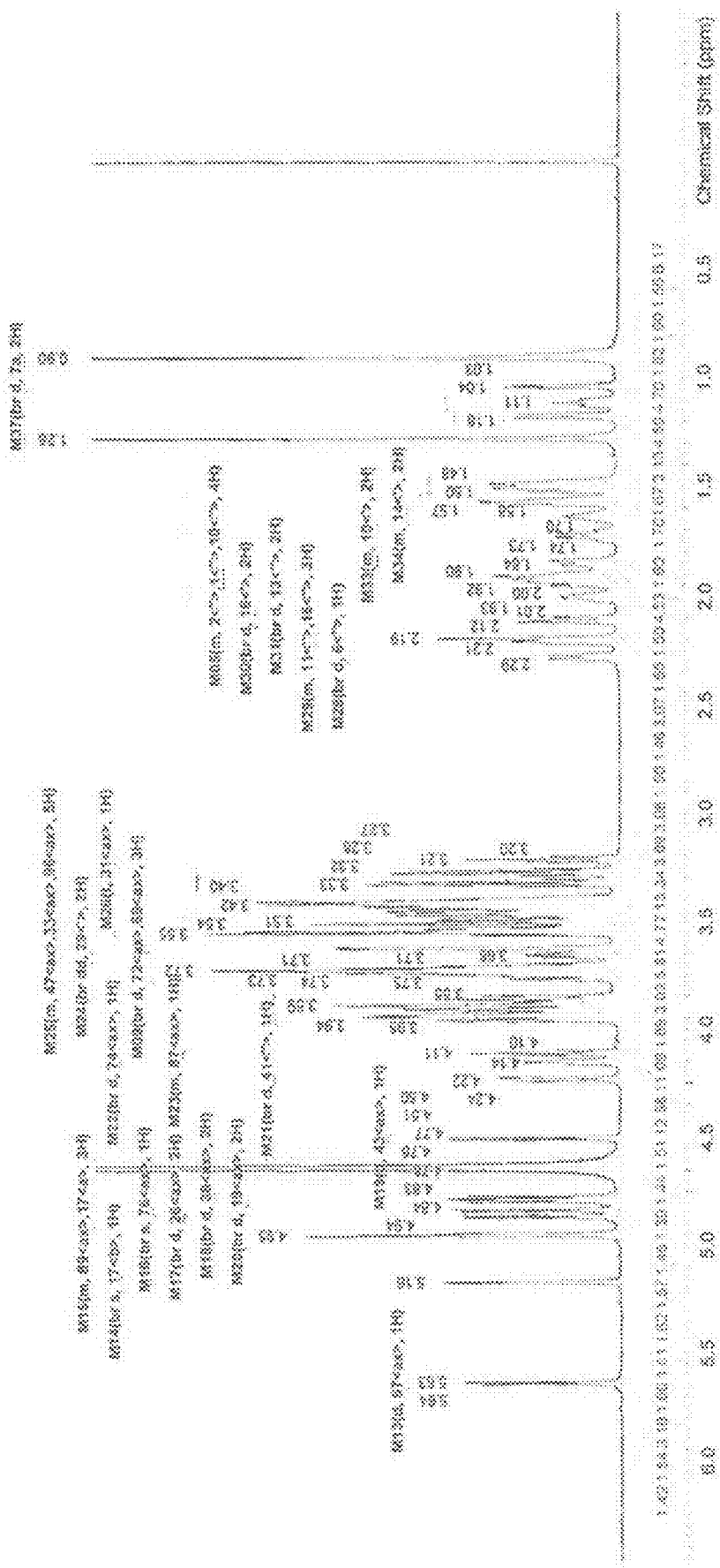
FIGS. 15R, 15S, 15T, and 15U show a $^1$H NMR spectrum and $^1$H and $^{13}$C NMR chemical shifts (in ppm) for steviol+7Glc (isomer 5).
Figure 15S:
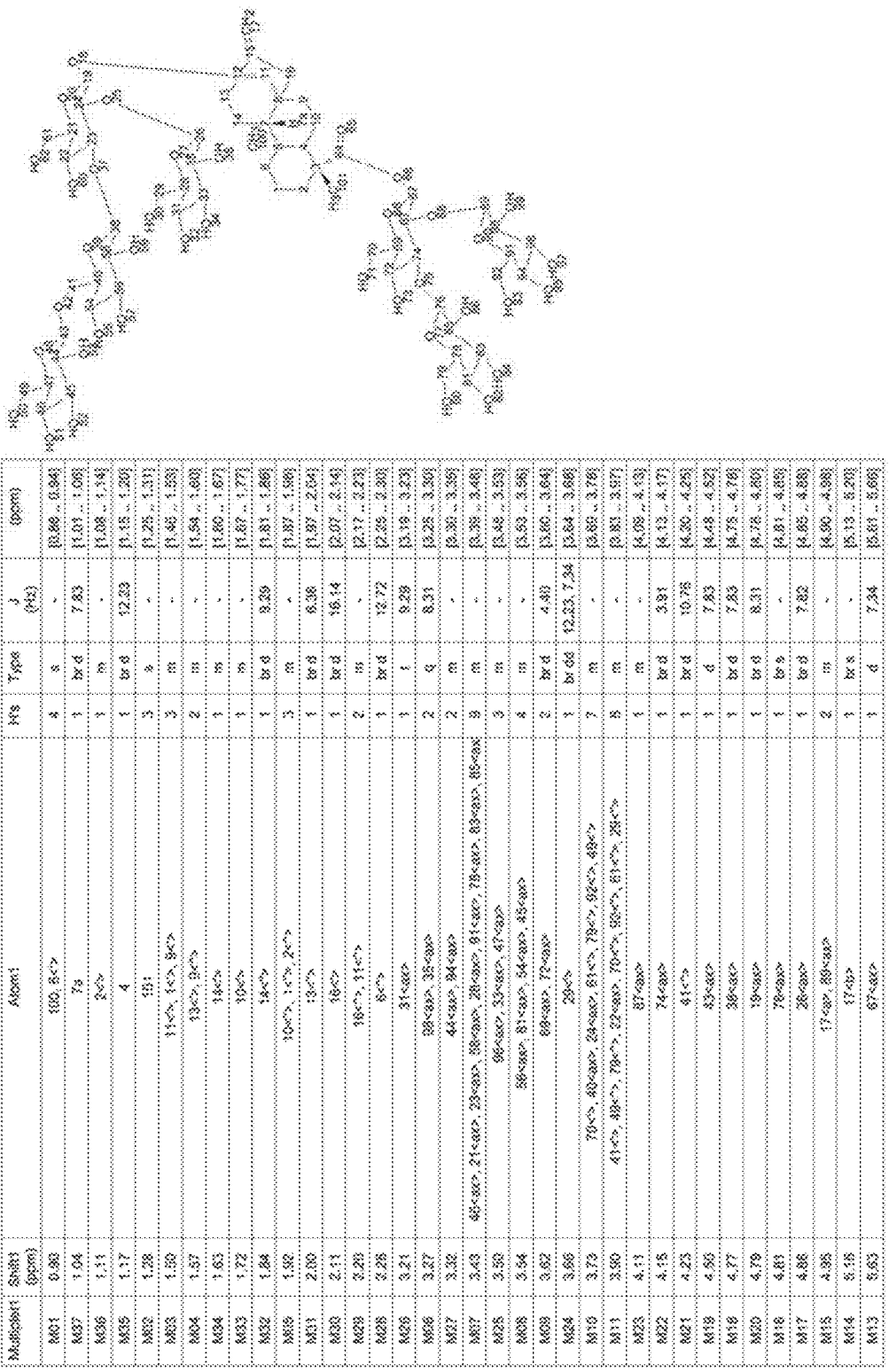
Figure 15T:
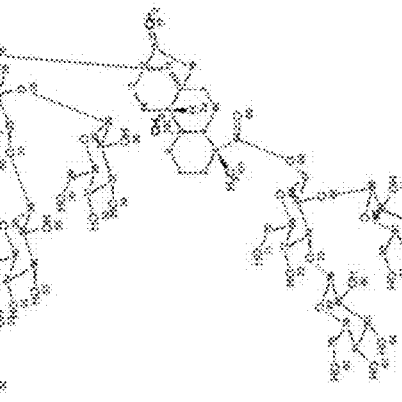
Figure 15U:
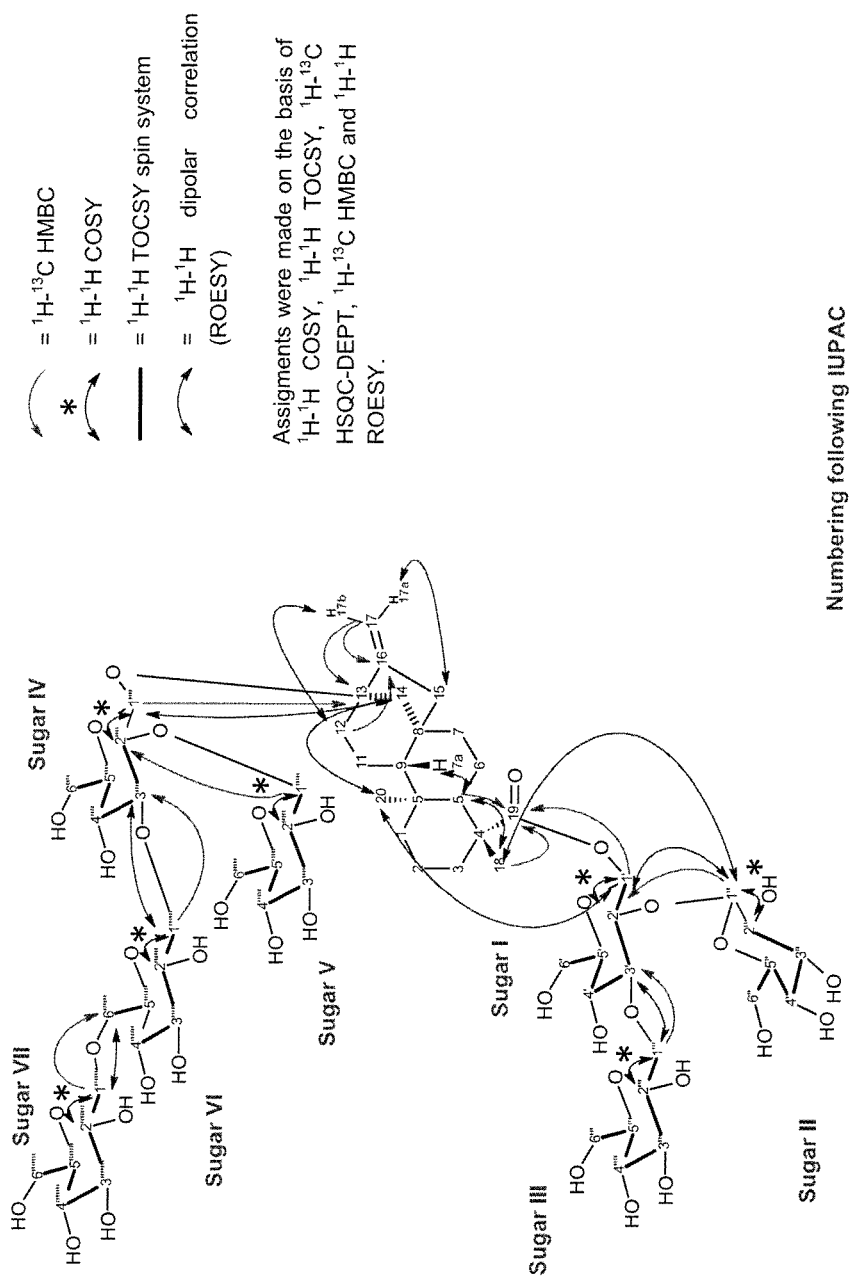
Figure 15V:
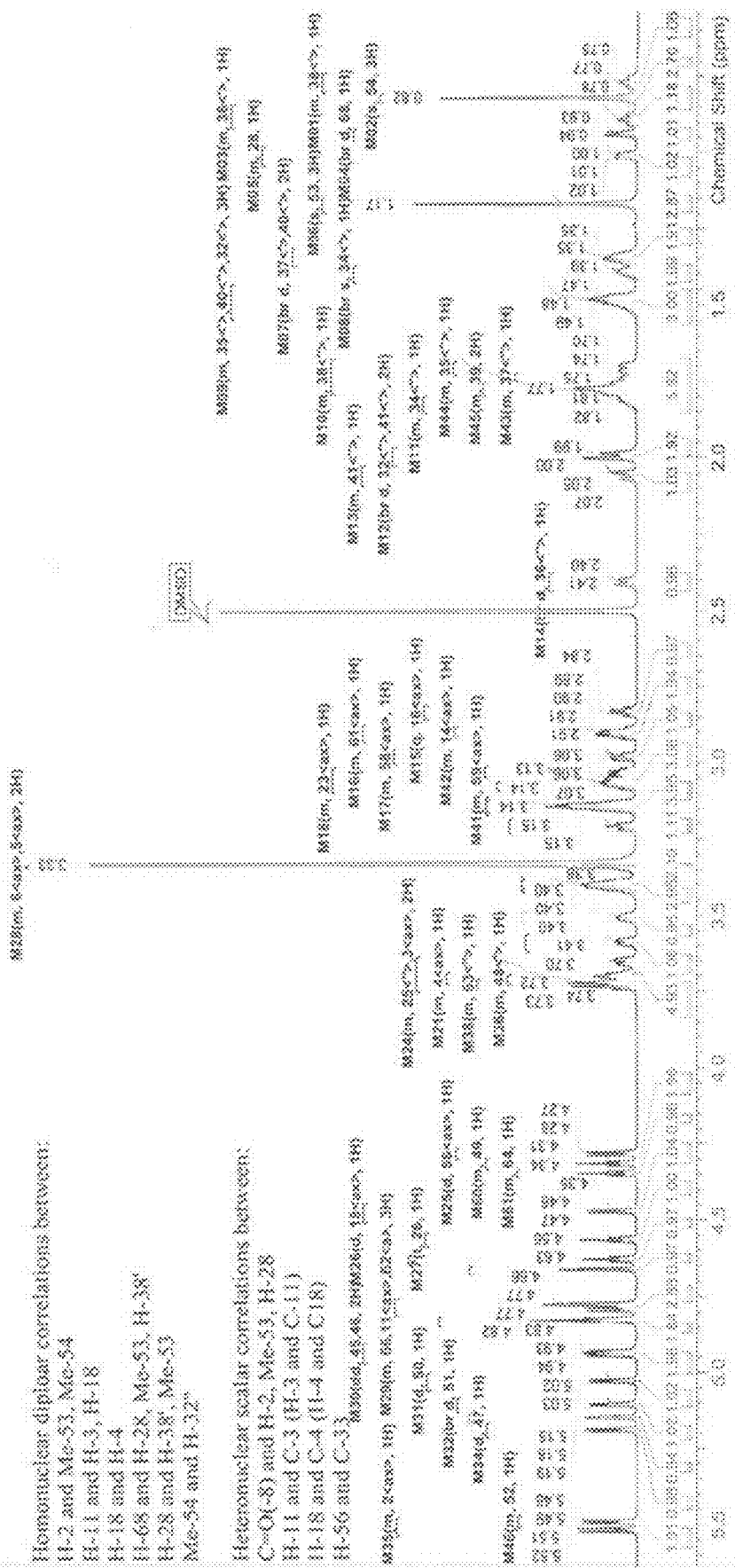
FIGS. 15V, 15W, 15X, and 15Y show a $^1$H NMR spectrum and $^1$H and $^{13}$C NMR chemical shifts (in ppm) for steviol+4Glc (#26).
Figure 15V:
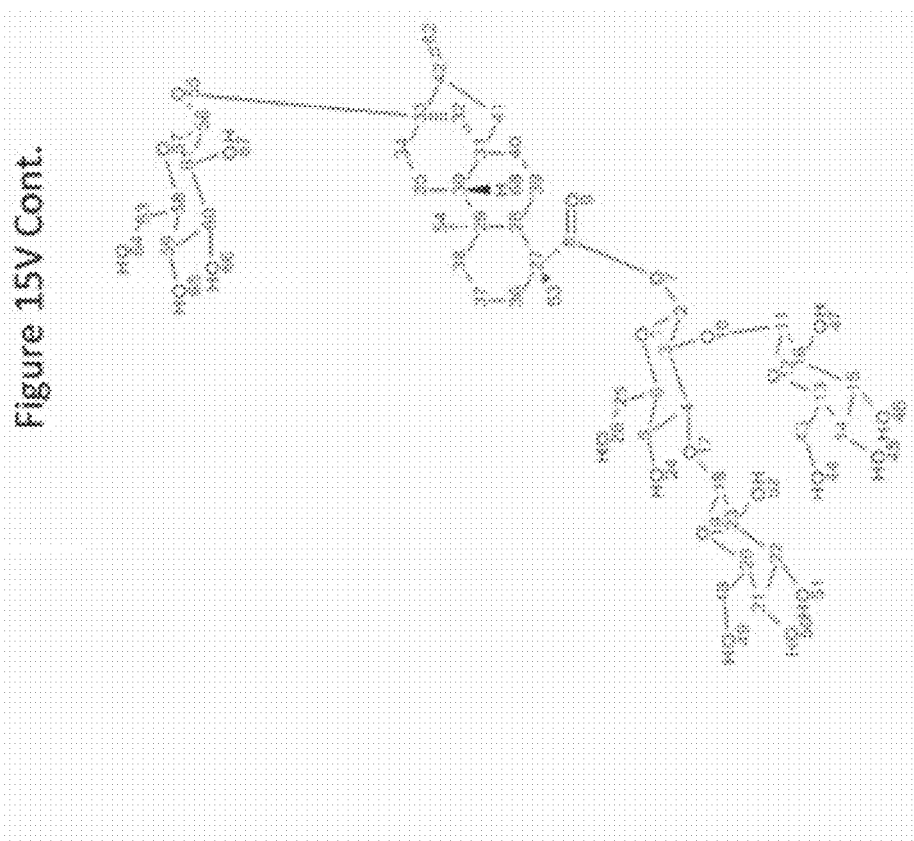
Figure 15W:
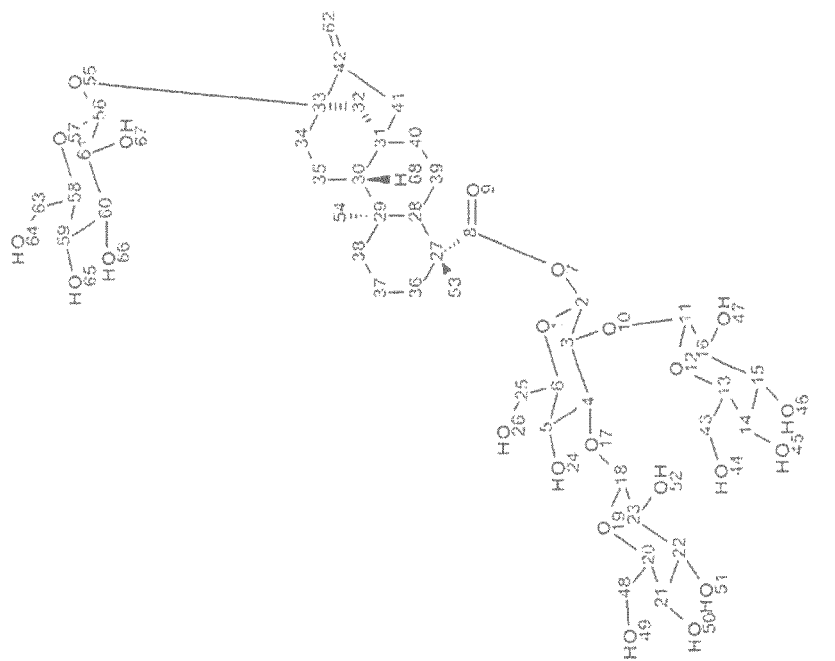
Figure 15X:
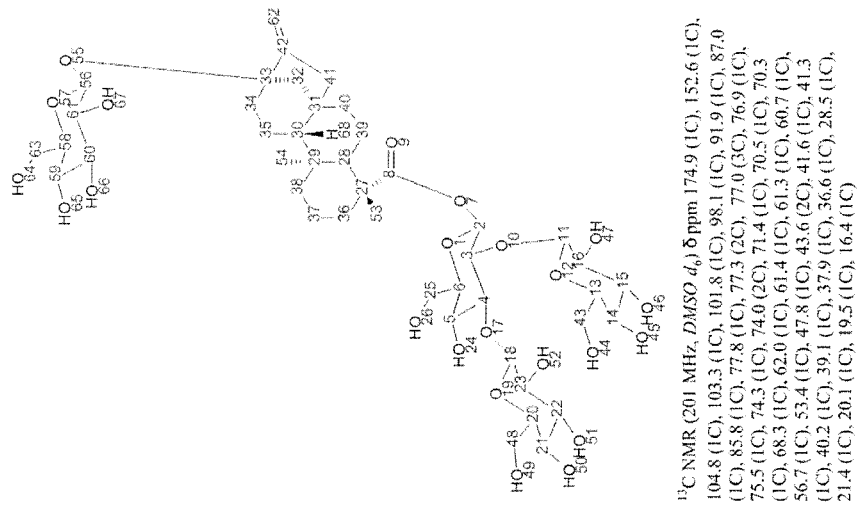
Figure 15Y:
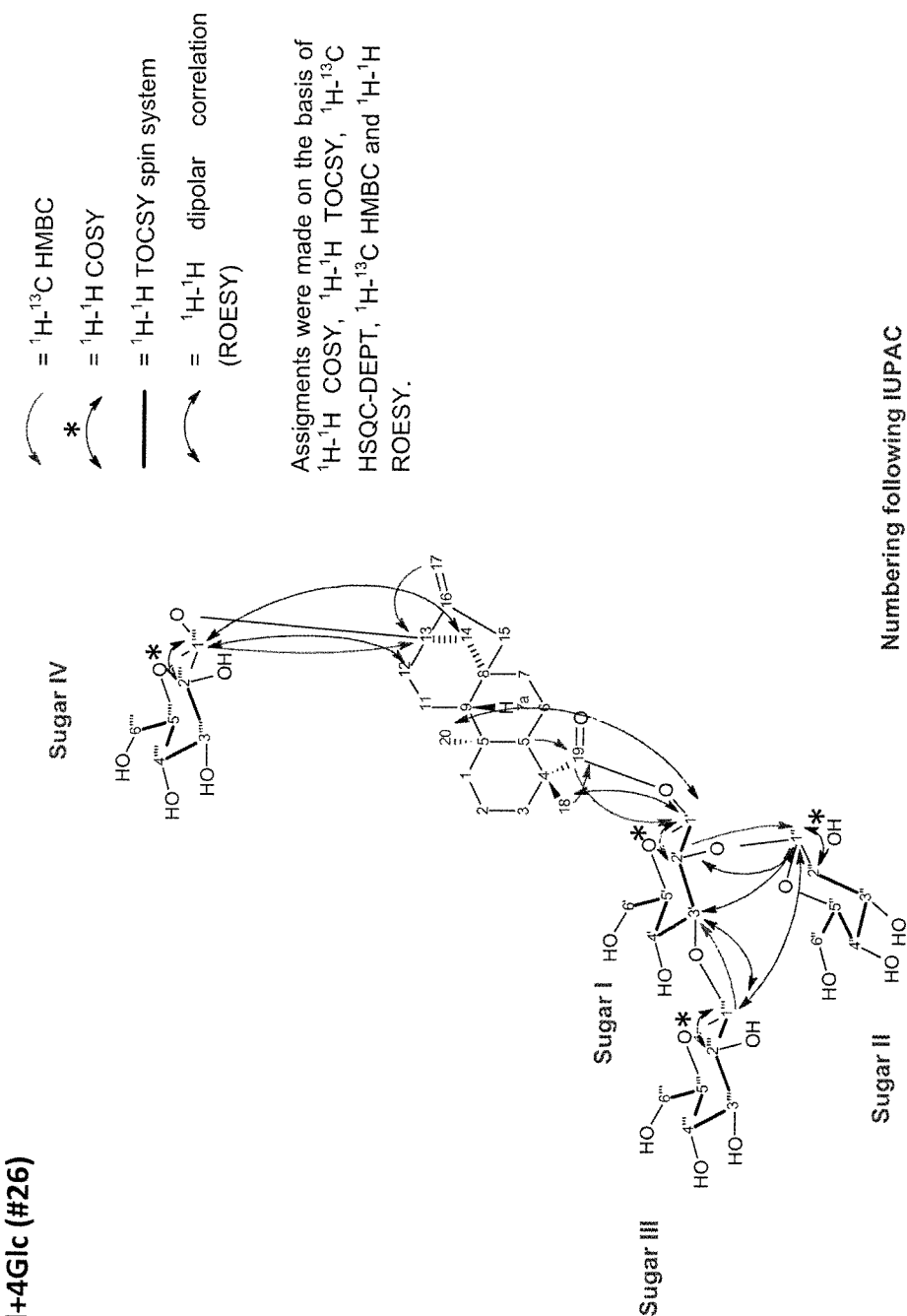

LC-MS analysis was performed according to Example 1. Results are shown in FIGS. 13 and 14.

Expression of tagged UGT74G1 polypeptides in a steviol glycoside-producing strain caused a decrease of accumulation of UGT74G1-dependant substrates, including KA+2Glc (#7), KA+3Glc (isomer2), KA+3Glc (isomer1), and 13-SMG. Without being bound by theory, the results suggest that expression of tagged UGT74G1 polypeptides having improved solubility increases accumulation of one or more steviol glycosides due to a better conversion of steviol precursors to steviol, and further glycosylation of steviol glycoside precursors towards, for example, RebD and RebM, as compared to wild-type UGT74G1 polypeptide.

Having described the invention in detail and by reference to specific embodiments thereof, it will be apparent that modifications and variations are possible without departing from the scope of the invention defined in the appended claims. More specifically, although some aspects of the present invention are identified herein as particularly advantageous, it is contemplated that the present invention is not necessarily limited to these particular aspects of the invention.

TABLE 19

Sequences disclosed herein.

SEQ ID NO: 1
Artificial Sequence

| | | | | | | |
|---|---|---|---|---|---|---|
| atggctgaac | aacaaaagat | caagaagtct | ccacacgttt | tgttgattcc | atttccattg | 60 |
| caaggtcaca | tcaacccatt | cattcaattc | ggtaagagat | tgatttccaa | gggtgttaag | 120 |
| actactttgg | ttactaccat | ccataccttg | aactctacct | tgaaccattc | taacactacc | 180 |
| accacctcca | ttgaaattca | agctatttcc | gatggttgtg | atgaaggtgg | ttttatgtct | 240 |
| gctggtgaat | cttacttgga | aacctttaag | caagttggtt | ctaagtcctt | ggccgatttg | 300 |
| attaagaagt | tgcaatctga | aggtactacc | attgatgcca | ttatctacga | ttctatgacc | 360 |
| gaatgggttt | tggatgttgc | tattgaattc | ggtattgatg | gtggttcatt | cttcactcaa | 420 |
| gcttgtgttg | ttaactcctt | gtactaccat | gttcacaagg | gtttgatctc | attgccattg | 480 |
| ggtgaaactg | tttctgttcc | aggtttccca | gttttacaaa | gatgggaaac | tccattgatc | 540 |
| ttgcaaaacc | acgaacaaat | tcaatctcca | tggtcccaaa | tgttgtttgg | tcaattcgcc | 600 |
| aacattgatc | aagctagatg | ggttttttacc | aactccttct | acaagttgga | agaagaagtt | 660 |
| atcgaatgga | ccagaaagat | ctggaacttg | aaagttattg | gtccaacctt | gccatctatg | 720 |
| tacttggata | agagattgga | tgacgataag | gacaacggtt | tcaacttgta | caaggctaac | 780 |
| catcatgaat | gcatgaattg | gttggacgac | aagccaaaag | aatccgttgt | ttatgttgct | 840 |
| ttcggttctt | tggtcaaaca | tggtccagaa | caagttgaag | aaattaccag | agccttgatc | 900 |
| gattccgatg | ttaatttctt | gtgggtcatc | aagcacaaag | aagaaggtaa | attgccagaa | 960 |
| aacttgtccg | aagttatcaa | aactggtaag | ggtttgattg | tcgcttggtg | taaacaattg | 1020 |
| gatgttttgg | ctcatgaatc | cgttggttgt | ttcgttactc | attgtggttt | caactccacc | 1080 |
| ttggaagcta | tttctttggg | tgttccagtt | gttgctatgc | cacaattttc | tgatcaaact | 1140 |
| accaacgcta | agttgttgga | cgaaattttg | ggtgttggtg | ttagagttaa | ggctgacgaa | 1200 |
| aatggtatcg | ttaagaagagg | taacttggct | tcttgcatca | agatgatcat | ggaagaagaa | 1260 |
| agaggtgtca | tcattagaaa | gaacgctgtt | aagtggaagg | attttggctaa | agttgctgtt | 1320 |
| catgaaggtg | gtagttccga | taatgatatc | gttgaattcg | tttccgaatt | gatcaaggcc | 1380 |
| taa | | | | | | 1383 |

SEQ ID NO: 2
Artificial Sequence

| | | | | | | |
|---|---|---|---|---|---|---|
| atggctgaac | aacaaaagat | caagaagtct | ccacacgttt | tgttgattcc | atttccattg | 60 |
| caaggtcaca | tcaacccatt | cattcaattc | ggtaagagat | tgatttccaa | gggtgttaag | 120 |
| actactttgg | ttactaccat | ccataccttg | aactctacct | tgaaccattc | taacactacc | 180 |
| accacctcca | ttgaaattca | agctatttcc | gatggttgtg | atgaaggtgg | ttttatgtct | 240 |
| gctggtgaat | cttacttgga | aacctttaag | caagttggtt | ctaagtcctt | ggccgatttg | 300 |
| attaagaagt | tgcaatctga | aggtactacc | attgatgcca | ttatctacga | ttctatgacc | 360 |
| gaatgggttt | tggatgttgc | tattgaattc | ggtattgatg | gtggttcatt | cttcactcaa | 420 |
| gcttgtgttg | ttaactcctt | gtactaccat | gttcacaagg | gtttgatctc | attgccattg | 480 |
| ggtgaaactg | tttctgttcc | aggtttccca | gttttacaaa | gatgggaaac | tccattgatc | 540 |
| ttgcaaaacc | acgaacaaat | tcaatctcca | tggtcccaaa | tgttgtttgg | tcaattcgcc | 600 |
| aacattgatc | aagctagatg | ggttttttacc | aactccttct | acaagttgga | agaagaagtt | 660 |
| atcgaatgga | ccagaaagat | ctggaacttg | aaagttattg | gtccaacctt | gccatctatg | 720 |
| tacttggata | agagattgga | tgacgataag | gacaacggtt | tcaacttgta | caaggctaac | 780 |
| catcatgaat | gcatgaattg | gttggacgac | aagccaaaag | aatccgttgt | ttatgttgct | 840 |
| ttcggttctt | tggtcgaaca | tggtccagaa | caagttgaag | aaattaccag | agccttgatc | 900 |
| gattccgatg | ttaatttctt | gtgggtcatc | aagcacaaag | aagaaggtaa | attgccagaa | 960 |
| aacttgtccg | aagttatcaa | aactggtaag | ggtttgattg | tcgcttggtg | taaacaattg | 1020 |
| gatgttttgg | ctcatgaatc | cgttggttgt | ttcgttactc | attgtggttt | caactccacc | 1080 |
| ttggaagcta | tttctttggg | tgttccagtt | gttgctatgc | cacaattttc | tgatcaaact | 1140 |
| accaacgcta | agttgttgga | cgaaattttg | ggtgttggtg | ttagagttaa | ggctgacgaa | 1200 |
| aatggtatcg | ttaagaagagg | taacttggct | tcttgcatca | agatgatcat | ggaagaagaa | 1260 |
| agaggtgtca | tcattagaaa | gaacgctgtt | aagtggaagg | attttggctaa | agttgctgtt | 1320 |
| catgaaggtg | gtagttccga | taatgatatc | gttgaattcg | tttccgaatt | gatcaaggcc | 1380 |
| taa | | | | | | 1383 |

TABLE 19-continued

Sequences disclosed herein.

SEQ ID NO: 3
Stevia rebaudiana

```
atggcagagc aacaaaagat caaaaagtca cctcacgtct tacttattcc atttcctctg    60
caaggacata tcaacccatt catacaattt gggaaaagat tgattagtaa gggtgtaaag   120
acaacactgg taaccactat ccacactttg aattctactc tgaaccactc aaatactact   180
actacaagta tagaaattca agctatatca gacggatgcg atgagggtgg ctttatgtct   240
gccggtgaat cttacttgga aacattcaag caagtgggat ccaagtctct ggccgatcta   300
atcaaaaagt tacagagtga aggcaccaca attgacgcca taatctacga ttctatgaca   360
gagtgggttt tagacgttgc tatcgaattt ggtattgatg gaggtccctt tttcacacaa   420
gcatgtgttg tgaattctct atactaccat gtgcataaag ggttaatctc tttaccattg   480
ggtgaaactg tttcagttcc aggtttttcca tgttacaaac gttgggaaac cccattgatc   540
ttacaaaatc atgaacaaat acaatcacct tggtcccaga tgttgtttgg tcaattcgct   600
aacatcgatc aagcaagatg ggtctttact aattcattct ataagttaga ggaagaggta   660
attgaatgga ctaggaagat ctggaatttg aaagtcattg gtccaacatt gccatcaatg   720
tatttggaca aaagacttga tgatgataaa gataatggtt tcaatttgta caaggctaat   780
catcacgaat gtatgaattg gctggatgac aaaccaaagg aatcagttgt atatgttgct   840
ttcggctctc ttgttaaaca tggtccagaa caagttgagg agattacaag agcacttata   900
gactctgacg taaactttt gtgggtcatt aagcacaaag aggagggaa actgccagaa    960
aacctttctg aagtgataaa gaccggaaaa ggtctaatcg ttgcttggtg taaacaattg   1020
gatgttttag ctcatgaatc tgtaggctgt tttgtaacac attgcggatt caactctaca   1080
ctagaagcca tttccttagg cgtacctgtc gttgcaatgc ctcagttctc cgatcagaca   1140
accaacgcta aacttttgga cgaaatacta ggggtgggtg tcagagttaa agcagacgag   1200
aatggtatcg tcagaagagg gaaccctagct tcatgtataa aaatgatcat ggaagaggaa   1260
agaggagtta tcataaggaa aacgcagtt aagtggaagg atcttgcaaa ggttgccgtc   1320
catgaaggcg gctcttcaga taatgatatt gttgaatttg tgtccgaact aatcaaagcc   1380
taa                                                                 1383
```

SEQ ID NO: 4
Stevia rebaudiana

```
MAEQQKIKKS PHVLLIPFPL QGHINPFIQF GKRLISKGVK TTLVTTIHTL NSTLNHSNTT    60
TTSIEIQAIS DGCDEGGFMS AGESYLETFK QVGSKSLADL IKKLQSEGTT IDAIIYDSMT   120
EWVLDVAIEF GIDGGSFFTQ ACVVNSLYYH VHKGLISLPL GETVSVPGFP VLQRWETPLI   180
LQNHEQIQSP WSQMLFGQFA NIDQARWVFT NSFYKLEEEV IEWTRKIWNL KVIGPTLPSM   240
YLDKRLDDDK DNGFNLYKAN HHECMNWLDD KPKESVVYVA FGSLVKHGPE QVEEITRALI   300
DSDVNFLWVI KHKEEGKLPE NLSEVIKTGK GLIVAWCKQL DVLAHESVGC FVTHCGFNST   360
LEAISLGVPV VAMPQFSDQT TNAKLLDEIL GVGVRVKADE NGIVRRGNLA SCIKMIMEEE   420
RGVIIRKNAV KWKDLAKVAV HEGGSSDNDI VEFVSELIKA                         460
```

SEQ ID NO: 5
Stevia rebaudiana

```
atggatgcaa tggctacaac tgagaagaaa ccacacgtca tcttcatacc atttccagca    60
caaagccaca ttaaagccat gctcaaacta gcacaacttc tccaccacaa aggactccag   120
ataaccttcg tcaacaccga cttcatccac aaccagtttc ttgaatcatc gggcccacat   180
tgtctagacg gtgcaccggg tttccggttc gaaaccattc acgatggtgt ttctacagtt   240
ccggaagcga gcatcccaat cagagaatca ctcttgagat ccattgaaac caacttcttg   300
gatcgtttca ttgatcttgt aaccaaactt ccggatcctc cgacttgtat tatctcagat   360
gggttcttgt cggttttcac aattgacgct gcaaaaagc ttggaattcc ggtcatgatg   420
tattggacac ttgctgcctg tggttcatg ggttttttacc atattcattc tctcattgag   480
aaaggatttg caccacttaa agatgcaagt tacttgacaa atgggtattt ggacaccgtc   540
attgattggg ttccgggaat ggaaggcatc cgtctcaagg atttcccgct ggactggagc   600
actgacctca tgacaaagt tttgatgttc actacggaag ctcctcaaag gtcacacaag   660
gtttcacatc atatttttcca cacgttcgat gagttggagc ctagtattat aaaaaactt   720
tcattgaggt ataatcacat ttaccaccatc ggcccactgc aattacttct tgatcaaata   780
cccgaagaga aaaagcaaac tggaattacg agtctccatg gatacagttt agtcaaaagaa   840
gaaccagagt gtttccagtg gcttcagtct aaagaaccaa attccgtcgt ttatgtaaat   900
tttgaagta ctacagtaat gtcttagaa gacatgacgg aatttggttg gggacttgct   960
aatagcaacc attatttcct ttggatcatc cgatcaaact tggtgatagg ggaaaatgca  1020
gttttgcccc ctgaacttga ggaacatata aagaaaagag gctttattgc tagctggtgt  1080
tcacaagaaa aggtcttgaa gcaccctcg gttggagggt tcttgactca ttgtgggtgg  1140
ggatcgacca tcgagagctt gtctgctggg gtgccaatga tatgctggcc ttattcgtgg  1200
gaccagctga ccaactgtag tgtatatgc aaagaatggg aggttgggct cgagatggga  1260
accaaagtga aacagatgaa agtcaagagg cttgtacaag agttgatggg agaaggaggt  1320
cacaaaatga ggaacaaggc taaagattgg aagaaaagg ctcgcattgc aatagctcct  1380
aacggttcat cttcttgaa catagacaaa atggtcaagg aaatcaccgt gctagcaaga  1440
aactagttac aaagttgttt cacattgtgc tttctattta agatgtaact tgttctaat   1500
ttaatattgt ctagatgtat tgaaccataa gtttagtggg tctcaggaat tgatttttaa  1560
tgaaataatg gtcattaggg gtgagt                                        1586
```

SEQ ID NO: 6
Artificial Sequence

```
atggatgcaa tggcaactac tgagaaaaag cctcatgtga tcttcattcc atttcctgca    60
caatctcaca taaaggcaat gctaaagtta gcacaactat tacaccataa gggattacag   120
ataaccttcg tgaataccga cttcatccat aatcaattct tgaatctag tggccctcat   180
tgtttggacg gagcccccagg gtttagattc gaaacaattc ctgacggtgt tcacattcc   240
ccagaggcct ccatcccaat aagagagagt ttactgaggt caatagaaac caacttttg   300
gatcgtttca ttgacttggt cacaaaactt ccagacccac caacttgcat aatctctgat   360
ggcttcctgt cagtgtttac tatcgacgct gccaaaagt tgggtatccc agttatgatg   420
tactggactc ttgctgcatg cggttcatg ggtttcatc acatccattc tcttatcgaa   480
```

TABLE 19-continued

Sequences disclosed herein.

```
aagggttttg ctccactgaa agatgcatca tacttaacca acggctacct ggatactgtt    540
attgactggg taccaggtat ggaaggtata agacttaagt attttccttt ggattggtct    600
acagaccta  atgataaagt attgatgttt actacagaag ctccacaaag atctcataag    660
gtttcacatc atatctttca caccttgat  gaattggaac catcaatcat caaaaccttg    720
tctctaagat acaatcatat ctacactatt ggtccattac aattacttct agatcaaatt    780
cctgaagaga aaaagcaaac tggtattaca tccttacacg ctactctttt agtgaaagag    840
gaaccagaat gttttcaatg gctacaaagt aaagagccta attctgtgtt ctacgtcaac    900
ttcggaagta caacagtcat gtccttgaa  gatatgactg aatttggttg gggccttgct    960
aattcaaatc attactttct atggattatc aggtccaatt tggtaatagg ggaaaacgcc   1020
gtattacctc cagaattgga ggaacacatc aaaagagag  gtttcattgc ttcctggtgt   1080
tctcaggaaa aggtattgaa acatccttct gttggtggtt tccttactca ttgcggttgg   1140
ggctctacaa tcgaatcact aagtgcagga gttccaatga tttgttggcc atattcatgg   1200
gaccaactta caaattgtag gtatatctgt aaagagtggg aagttggatt agaaatggga   1260
acaaaggtta acgtgatga  agtgaaaaga ttggttcagg agttgatggg ggaaggtggc   1320
cacaagatga gaaacaaggc caaagattgg aaggaaaaag ccagaattgc tattgctcct   1380
aacgggtcat cctctctaaa cattgataag atggtcaaag agattacagt cttagccaga   1440
aactaa                                                               1446

SEQ ID NO: 7
Stevia rebaudiana
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                   481

SEQ ID NO: 8
Artificial Sequence
atggaaaaca agaccgaaac aacagttaga cgtaggcgta gaatcattct gtttccagta     60
ccttttcaag ggcacatcaa tccaatacta caactagcca acgttttgta ctctaaaggt    120
ttttctatta caatctttca caccaatttc aacaaaccaa aaacatccaa ttacccacat    180
ttcacattca gattcatact tgataatgat ccacaagatg aacgtatttc aaacttacct    240
acccacggtc ctttagctgg aatgagaatt ccaatcatca atgaacatgg tgccgatgag    300
cttagaagag aattagagtt acttatgttg gcatccgaag aggacgagga gtctctgt     360
ctgattactg acgtctatg  gtactttgcc caatctgtgg ctgatagttt gaatttgagg    420
agattggtac taatgacatc cagtctgttt aactttcacg ctcatgttag tttaccacaa    480
tttgacgaat tgggatactt ggaccctgat gacaagacta ggttagagga acaggcctct    540
ggttttccta tgttgaaagt caaagatatc aagtctgcct attctaattg gcaaatcttg    600
aaagagatct taggaaagat gatcaaacag acaaaggctt catctggagt gatttggaac    660
agtttcaaag agttagaaga gtctgaattg gagactgtta tcagagaaat tccagcacct    720
tcattcctga taccattacc aaaacatttg actgcttcct cttcctcttt gttggatcat    780
gacagaacag ttttttcaatg gttggaccaa caaccaccta gttctgtttt gtacgtgtca    840
tttggtagta cttctgaagt cgatgaaaag gacttccttg aaatcgcaag aggcttagtc    900
gatagtaagc agtcattcct ttgggtcgtg cgtccaggtt tcgtgaaagg tcaacatgg    960
gtcgaaccac ttccagatgg ttttctaggc gaaagaggta gaatagtcaa atggttcct    1020
caacaggaag ttttagctca tgccgctatt ggggcattct ggactcattc cggatggaat   1080
tcaacttttag aatcagtatg cgaaggggta cctatgatct tttcagattt tggtcttgat   1140
caaccactga acgcaagata catgtctgat gttttgaaag tgggtgtata tctagaaaat   1200
ggctgggaaa ggggtgaaat agctaatgca ataagacgtg ttatggttga tgaagagggg   1260
gagtatatca gacaaaacgc aagagtgctg aagcaaaagg ccgacgtttc tctaatgaag   1320
ggaggctctt catacgaatc cttagaatct cttgttccct acatttcatc actgtaa      1377

SEQ ID NO: 9
Stevia rebaudiana
MENKTETTVR RRRRIILFPV PFQGHINPIL QLANVLYSKG FSITIFHTNF NKPKTSNYPH     60
FTFRFILDND PQDERISNLP THGPLAGMRI PIINEHGADE LRRELELLML ASEEDEEVSC    120
LITDALWYFA QSVADSLNLR RLVLMTSSLF NFHAHVSLPQ FDELGYLDPD DKTRLEEQAS    180
GFPMLKVKDI KSAYSNWQIL KEILGKMIKQ TKASSGVIWN SFKELEESEL ETVIREIPAP    240
SFLIPLPKHL TASSSSLLDH DRTVFQWLDQ QPPSSVLYVS FGSTSEVDEK DFLEIARGLV    300
DSKQSFLWVV RPGFVKGSTW VEPLPDGFLG ERGRIVKWVP QQEVLAHGAI GAFWTHSGWN    360
STLESVCEGV PMIFSDFGLD QPLNARYMSD VLKVGVYLEN GWERGEIANA IRRVMVDEEG    420
EYIRQNARVL KQKADVSLMK GGSSYESLES LVSYISSL                            458

SEQ ID NO: 10
Artificial Sequence
atggctacat ctgattctat tgttgatgac aggaagcagt tgcatgtggc tactttccct     60
tggcttgctt tcggtcatat actgccttac ctacaactat caaaactgat agctgaaaaa    120
ggacataaag tgtcattcct ttcaacaact agaaacattc aaagattatc ttcccacata    180
tcaccattga ttaacgtcgt tcaattgaca cttccaagag tacaggaatt accagaagat    240
gctgaagcta caacgatgt  gcatcctgaa gatatcccag acttgaaaaa ggcatccgat    300
ggattacagc ctgaggtcac tagattcctg agcaacacca gtccagattg atcatatac    360
gactacactc actattggtt gccttcaatt gcagcatcac taggcatttc tagggcacat    420
ttcagtgtaa ccacaccttg ggccattgct tacatgggtc catccgctga tgctatgatt    480
aacggcagtg atggtagaac taccgttgaa gatttgacaa ccccaccaaa gtggtttcca    540
```

| | | | | |
|---|---|---|---|---|
| tttccaacta | aagtctgttg | gagaaaacac | gacttagcaa | gactggttcc atacaaggca | 600 |
| ccaggaatct | cagacggcta | tagaatgggt | ttagtcctta | aagggtctga ctgcctattg | 660 |
| tctaagtgtt | accatgagtt | tgggacacaa | tggctaccac | ttttggaaac attaccacaa | 720 |
| gttcctgtcg | taccagttgg | tctattacct | ccagaaatcc | ctggtgatga aaggacgag | 780 |
| acttgggttt | caatcaaaaa | gtggttagac | gggaagcaaa | aaggctcagt ggtatatgtg | 840 |
| gcactgggtt | ccgaagtttt | agtatctcaa | acagaagttg | tggaacttgc cttaggtttg | 900 |
| gaactatctg | gattgccatt | tgtctgggcc | tacagaaaac | caaaaggccc tgcaaagtcc | 960 |
| gattcagttg | aattgccaga | cggctttgtc | gagagaacta | gagatagagg ttggtatgg | 1020 |
| acttcatggg | ctccacaatt | gagaatcctg | agtcacgaat | ctgtgtgcgg tttcctaaca | 1080 |
| cattgtggtt | ctggttctat | agttgaagga | ctgatgtttg | gtcatccact tatcatgttg | 1140 |
| ccaatctttg | gtgaccagcc | tttgaatgca | cgtctgttag | aagataaaca agttggaatt | 1200 |
| gaaatcccac | gtaatgagga | agatggatgt | taaccaagg | agtctgtggc cagatcatta | 1260 |
| cgttccgttg | tcgttgaaaa | ggaaggcgaa | atctacaagg | ccaatgcccg tgaacttca | 1320 |
| aagatctaca | atgacacaaa | agtagagaag | gaatatgttt | ctcaatttgt agattaccta | 1380 |
| gagaaaaacg | ctagagccgt | agctattgat | catgaatcct | aa | 1422 |

SEQ ID NO: 11
Stevia rebaudiana
MATSDSIVDD RKQLHVATFP WLAFGHILPY LQLSKLIAEK GHKVSFLSTT RNIQRLSSHI   60
SPLINVVQLT LPRVQELPED AEATTDVHPE DIPYLKKASD GLQPEVTRFL EQHSPDWIIY  120
DYTHYWLPSI AASLGISRAH FSVTTPWAIA YMGPSADAMI NGSDGRTTVE DLTTPPKWFP  180
FPTKVCWRKH DLARLVPYKA PGISDGYRMG LVLKGSDCLL SKCYHEFGTQ WLPLLETLHQ  240
VPVVPVGLLP PEIPGDEKDE TWVSIKKWLD GKQKGSVVYV ALGSEVLVSQ TEVVELALGL  300
ELSGLPFVWA YRKPKGPAKS DSVELPDGFV ERTRDRGLVW TSWAPQLRIL SHESVCGFLT  360
HCGSGSIVEG LMFGHPLIML PIFGDQPLNA RLLEDKQVGI EIPRNEEDGC LTKESVARSL  420
RSVVEKEGE IYKANARELS KIYNDTKVEK EYVSQFVDYL EKNARAVAID HES          473

SEQ ID NO: 12
Artificial Sequence
| | | | | |
|---|---|---|---|---|
| atggctactt | ctgattccat | cgttgacgat | agaaagcaat | gcatgttgc tactttttcca | 60 |
| tggttggctt | tcggtcatat | tttgccatac | ttgcaattgt | ccaagttgat tgctgaaaag | 120 |
| ggtcacaagg | tttcattctt | gtctaccacc | agaaacattc | aaagattgtc ctctcatatc | 180 |
| tccccattga | tcaacgttgt | tcaattgact | ttgccaagag | tccaagaatt gccagaagat | 240 |
| gctgaagcta | ctactgatgt | tcatccagaa | gatatccctt | acttgaaaaa ggcttccgat | 300 |
| ggtttacaac | cagaagttac | tagattcttg | gaacaacatt | cccagattg gatcatctac | 360 |
| gattatactc | attactggtt | gccatccatt | gctgcttcat | tgggtatttc tagagcccat | 420 |
| ttctctgtta | ctactccatg | ggctattgct | tatatgggtc | catctgctga tgctatgatt | 480 |
| aacggttctg | atggtagaac | taccgttgaa | gatttgacta | ctccaccaaa gtggtttcca | 540 |
| tttccaacaa | aagtctgttg | gagaaaacac | gatttggcta | gattggttcc atacaaagct | 600 |
| ccaggtattt | ctgatggtta | cagaatgggt | atggttttga | aaggttccga ttgcttgttg | 660 |
| tctaagtgct | atcatgaatt | cggtactcaa | tggttgcctt | tgttggaaac attgcatcaa | 720 |
| gttccagttg | ttccagtagg | tttgttgcca | ccagaaattc | caggtgacga aaaagacgaa | 780 |
| acttgggttt | ccatcaaaaa | gtggttggat | ggtaagcaaa | agggttctgt tgtttatgtt | 840 |
| gctttgggtt | ccgaagtttt | ggtttctcaa | accgaagttg | ttgaattggc tttgggttg | 900 |
| gaattgtctg | gtttgccatt | tgtttggct | tacagaaaac | ctaaaggtcc agctaagtct | 960 |
| gattctgttg | aattgccaga | tggtttcgtt | gaaagaacta | gagatagagg tttggttgg | 1020 |
| acttcttggg | ctccacaatt | gagaattttg | tctcatgaat | ccgtctgtgg tttcttgact | 1080 |
| cattgtggtt | ctggttctat | cgttgaaggt | ttgatgtttg | gtcacccatt gattatgttg | 1140 |
| ccaatctttg | gtgaccaacc | attgaacgct | agattattgg | aagataagca agtcggtatc | 1200 |
| gaaatcccaa | gaaatgaaga | agatggttgc | ttgaccaaag | aatctgttgc tagatctttg | 1260 |
| agatccgttg | tcgttgaaaa | agaaggtgaa | atctacaagg | ctaacgctag agaattgtcc | 1320 |
| aagatctaca | acgataccaa | ggtcgaaaaa | gaatacgttt | cccaattcgt tgactacttg | 1380 |
| gaaaagaatg | ctagagctgt | tgccattgat | catgaatctt | ga | 1422 |

SEQ ID NO: 13
Artificial Sequence
MATSDSIVDD RKQLHVATFP WLAFGHILPY LQLSKLIAEK GHKVSFLSTT RNIQRLSSHI   60
SPLINVVQLT LPRVQELPED AEATTDVHPE DIPYLKKASD GLQPEVTRFL EQHSPDWIIY  120
DYTHYWLPSI AASLGISRAH FSVTTPWAIA YMGPSADAMI NGSDGRTTVE DLTTPPKWFP  180
FPTKVCWRKH DLARLVPYKA PGISDGYRMG MVLKGSDCLL SKCYHEFGTQ WLPLLETLHQ  240
VPVVPVGLLP PEIPGDEKDE TWVSIKKWLD GKQKGSVVYV ALGSEALVSQ TEVVELALGL  300
ELSGLPFVWA YRKPKGPAKS DSVELPDGFV ERTRDRGLVW TSWAPQLRIL SHESVCGFLT  360
HCGSGSIVEG LMFGHPLIML PIFGDQPLNA RLLEDKQVGI EIPRNEEDGC LTKESVARSL  420
RSVVEKEGE IYKANARELS KIYNDTKVEK EYVSQFVDYL EKNARAVAID HES          473

SEQ ID NO: 14
Oryza sativa
| | | | | |
|---|---|---|---|---|
| atggactccg | gctactcctc | ctcctacgcc | gccgccgccg | ggatgcacgt cgtgatctgc | 60 |
| ccgtggctcg | ccttcggcca | cctgctcccg | tgcctcgacc | tcgcccagcg cctcgcctcg | 120 |
| cggggccacc | gcgtgtcgtt | cgtctccacg | ccgcggaaca | tatcccgcct cccgccggtg | 180 |
| cgccccgcgc | tcgcgccgct | cgtcgccttc | gtggcgctgc cgctcccgcg cgtcgagggg | 240 |
| ctccccgacg | gcgccgagtc | caccaacgac | gtccccacg | acaggccgga catggtcgag | 300 |
| tccaccggga | gggccttcga | cgggctccga | cgccctctc | cggagttctt gggcaccgcg | 360 |
| tgcgccgact | gggtcatcgt | cgacgtcttc | caccactggg | cgcagccgc cgctctcgag | 420 |
| cacaaggtgc | catgtgcaat | gatgttgtt | ggctctgcac atatgatcgc ttccatagca | 480 |
| gacagacggc | tcgagcgcgc | ggagacagag | tcgcctgcgg | ctgccgggca gggacgccca | 540 |
| gcggcggcgc | caacgttcga | ggtggcgagg | atgaagttga | tacgaaccaa aggctcatcg | 600 |
| ggaatgtccc | tcgccgagcg | cttctccttg | acgctctcga | ggagcagcct cgtcgtcggg | 660 |

TABLE 19-continued

Sequences disclosed herein.

```
cggagctgcg tggagttcga gccggagacc gtcccgctcc tgtcgacgct ccgcggtaag    720
cctattacct tccttggcct tatgccgccg ttgcatgaag gccgccgcga ggacggcgag    780
gatgccaccg tccgctggct cgacgcgcag ccggccaagt ccgtcgtgta cgtcgcgcta    840
ggcagcgagg tgccactggg agtggagaag gtccacgagc tcgcgctcgg gctggagctc    900
gccgggacgc gcttcctctg ggctcttagg aagcccactg gcgtctccga cgccgacctc    960
ctccccgccg gcttcgagga gcgcacgcgc ggccgcggcg tcgtggcgac gagatgggtt   1020
cctcagatga gcatactggc gcacgcgcc gtgggcgcgt tcctgacccg ctgcggctgg   1080
aactcgacca tcgaggggct catgttcggc caccccgctta tcatgctgcc gatcttcggc   1140
gaccagggac cgaacgcgcg gctaatcgag gcgaagaacg ccggattgca ggtggcaaga   1200
aacgacgcg atggatcgtt cgaccgagaa ggcgtcgcgg cggcgattcg tgcagtcgcg   1260
gtggaggaag aaagcagcaa agtgtttcaa gccaaagcca agaagctgca ggagatcgtc   1320
gcggacatgg cctgccatga gaggtacatc gacggattca ttcagcaatt gagatcttac   1380
aaggattga                                                            1389

SEQ ID NO: 15
Artificial Sequence
atggatagtg gctactcctc atcttatgct gctgccgctg gtatgcacgt tgtgatctgc    60
ccttggttga cctttggtca cctgttacca tgtctggatt tagcccaaag actggcctca   120
agaggccata gagtatcatt tgtgtctact cctagaaata tctctcgttt accaccagtc   180
agacctgctc tagctcctct agttgcattc gttgctcttc cacttccaag agtagaagga   240
ttgccagacg gcgctgaatc tactaatgac gtaccacatg atagacctga catggtcgaa   300
ttgcatagaa gagcctttga tggattggca gctccatttt ctgagttcct gggcacagca   360
tgtgcagact gggttatagt cgatgtattt catcactggg ctgctgcagc cgcattggaa   420
cataaggtgc cttgtgctat gatgttgtta gggtcagcac acatgatcgc atccatagct   480
gatagaagat tggaaagagc tgaaacagaa tccccagccg cagcaggaca aggtaggcca   540
gctgccgccc caacctttga agtggctaga atgaaattga ttcgtactaa aggtagttca   600
gggatgagtc ttgctgaaag gttttctctg acattatcta gatcatcatc agttgtaggt   660
agatcctgcg tcgagttcga acctgaaaca gtaccttttac tatctacttt gagaggcaaa   720
cctattactt tccttggtct aatgcctcca ttacatgaag gaaggagaga gatggtgaa    780
gatgctactg ttaggtggtt agatgcccaa cctgctaagt ctgttgttta cgttgcattg    840
ggttctgagg taccactagg ggtggaaaag gtgcatgaat tagcattagg acttgagctg    900
gccggaacaa gattcctttg ggctttgaga aaaccaaccg gtgtttctga cgccgacttg    960
ctaccagctg ggttcgaaga gagaacaaga ggccgtggtg tcgttgctac tagatgggtc   1020
ccacaaatga gtattctagc tcatgcagct gtaggggcct ttctaaccca ttgcggttgg   1080
aactcaacaa tagaaggact gatgtttggt catccactta ttatgttacc aatctttggc   1140
gatcagggac ctaacgcaag attgattgag gcaaagaacg caggtctgca ggttgcacgt   1200
aatgatggtg atggttcctt tgatagagaa ggcgttgcag ctgccatcag agcagtcgcc   1260
gttgaggaag agtcatctaa agttttccaa gctaaggcca aaaaattaca agagattgtg   1320
gctgacatgg cttgtcacga agatacatc atgggtttca ccaacaatt gagaagttat   1380
aaagactaa                                                            1389

SEQ ID NO: 16
Oryza sativa
MDSGYSSSYA AAAGMHVVIC PWLAFGHLLP CLDLAQRLAS RGHRVSFVST PRNISRLPPV     60
RPALAPLVAF VALPLPRVEG LPDGAESTND VPHDRPDMVE LHRRAFDGLA APFSEFLGTA    120
CADWVIVDVF HHWAAAAALE HKVPCAMMLL GSAHMIASIA DRRLERAETE SPAAAGQGRP    180
AAAPTFEVAR MKLIRTKGSS GMSLAERFSL TLSRSSLVVG RSCVEFEPET VPLLSTLRGK    240
PITFLGLMPP LHEGRREDGE DATVRWLDAQ PAKSVVYVAL GSEVPLGVEK VHELALGLEL    300
AGTRFLWALR KPTGVSDADL LPAGFEERTR GRGVVATRWV PQMSILAHAA VGAFLTHCGW    360
NSTIEGLMFG HPLIMLPIFG DQGPNARLIE AKNAGLQVAR NDGDGSFDRE GVAAAIRAVA    420
VEEESSKVFQ AKAKKLQEIV ADMACHERYI DGFIQQLRSY KD                       462

SEQ ID NO: 17
Artificial Sequence
MDSGYSSSYA AAAGMHVVIC PWLAFGHLLP CLDLAQRLAS RGHRVSFVST PRNISRLPPV     60
RPALAPLVAF VALPLPRVEG LPDGAESTND VPHDRPDMVE LHRRAFDGLA APFSEFLGTA    120
CADWVIVDVF HHWAAAAALE HKVPCAMMLL GSAHMIASIA DRRLERAETE SPAAAGQGRP    180
AAAPTFEVAR MKLIRTKGSS GMSLAERFSL TLSRSSLVVG RSCVEFEPET VPLLSTLRGK    240
PITFLGLLPP EIPGDEKDET WVSIKKWLDG KQKGSVVYVA LGSEALVSQT EVVELALGLE    300
LSGLPFVWAY RKPKGPAKSD SVELPDGFVE RTRDRGLVWT SWAPQLRILS HESVCGFLTH    360
CGSGSIVEGL MFGHPLIMLP IFGDQPLNAR LLEDKQVGIE IARNDGDGSF DREGVAAAIR    420
AVAVEEESSK VFQAKAKKLQ EIVADMACHE RYIDGFIQQL RSYKD                    465

SEQ ID NO: 18
Artificial Sequence
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHSPDWIIY    120
DYTHYWLPSI AASLGISRAH FSVTTPWAIA YMGPSADAMI NGSDGRTTVE DLTTPPKWFP    180
FPTKVCWRKH DLARLVPYKA PGISDGYRMG MVLKGSDCLL SKCYHEFGTQ WLPLLETLHQ    240
VPVVPVGLMP PLHEGRREDG EDATVRWLDA QPAKSVVYVA LGSEVPLGVE KVHELALGLE    300
LAGTRFLWAL RKPTGVSDAD LLPAGFEERT RGRGVVATRW VPQMSILAHA AVGAFLTHCG    360
WNSTIEGLMF GHPLIMLPIF GDQGPNARLI EAKNAGLQVP RNEEDGCLTK ESVARSLRSV    420
VVEKEGEIYK ANARELSKIY NDTKVEKEYV SQFVDYLEKN ARAVAIDHES               470

SEQ ID NO: 19
Artificial Sequence
atggctttgg taaacccaac cgtcttttc tatggtacct ctatcagaac aagacctaca     60
aacttactaa atccaactca aaagctaaga ccagtttcat catcttcctt accttctttc   120
```

TABLE 19-continued

Sequences disclosed herein.

```
tcatcagtta gtgcgattct tactgaaaaa catcaatcta atccttctga gaacaacaat    180
ttgcaaactc atctagaaac tccttcaac tttgatagtt atatgttgga aaaagtcaac    240
atggttaacg aggcgcttga tgcatctgtc ccactaaaag acccaatcaa aatccatgaa    300
tccatgagat actctttatt ggcaggcggt aagagaatca gaccaatgat gtgtattgca    360
gcctgcgaaa tagtcggagg taatatcctt aacgccatgc cagccgcatg tgccgtggaa    420
atgattcata ctatgtcttt ggtgcatgac gatcttccat gtatggataa tgatgacttc    480
agaagaggta aacctatttc acacaaggtc tacggggagg aaatggcagt attgaccggc    540
gatgctttac taagtttatc tttcgaacat atagctactg ctacaaaggg tgtatcaaag    600
gatagaatcg tcagagctat aggggagttg gcccgttcag ttggctccga aggtttagtg    660
gctggacaag ttgtagatat cttgtcagag ggtgctgatg ttggattaga tcacctagaa    720
tacattcaca tccacaaaac agcaatgttg cttgagtcct cagtagttat tggcgctatc    780
atgggaggag gatctgatca gcagatcgaa aagttgagaa aattcgctag atctattggt    840
ctactattcc aagttgtgga tgacattttg gatgttacaa aatctaccga agagttgggg    900
aaaacagctg gtaaggattt gttgacagat aagacaactt acccaaagtt gttaggtata    960
gaaaagtcca gagaatttgc cgaaaaactt aacaaggaag cacaagagca attaagtggc   1020
tttgatagac gtaaggcagc tcctttgatc gcgttagcca actacaatgc gtaccgtcaa   1080
aattga                                                             1086

SEQ ID NO: 20
Stevia rebaudiana
MALVNPTALF YGTSIRTRPT NLLNPTQKLR PVSSSSLPSF SSVSAILTEK HQSNPSENNN     60
LQTHLETPFN FDSYMLEKVN MVNEALDASV PLKDPIKIHE SMRYSLLAGG KRIRPMMCIA    120
ACEIVGGNIL NAMPAACAVE MIHTMSLVHD DLPCMDNDDF RRGKPISHKV YGEEMAVLTG    180
DALLSLSFEH IATATKGVSK DRIVRAIGEL ARSVGSEGLV AGQVVDILSE GADVGLDHLE    240
YIHIHKTAML LESSVVIGAI MGGGSDQQIE KLRKFARSIG LLFQVVDDIL DVTKSTEELG    300
KTAGKDLLTD KTTYPKLLGI EKSREFAEKL NKEAQEQLSG FDRRKAAPLI ALANYNAYRQ    360
N                                                                   361

SEQ ID NO: 21
Artificial Sequence
atggctgagc aacaaatatc taacttgctg tctatgtttg atgcttcaca tgctagtcag     60
aaattagaaa ttactgtcca aatgatggac acataccatt acagagaaac gcctccagat    120
tcctcatctt ctgaaggcgg ttcattgtct agatacgacg agagaagagt ctctttgcct    180
ctcagtcata atgctgcctc tccagatatt gtatcacaac tatgttttc cactgcaatg    240
tcttcagagt tgaatcacag atggaaatct caaagattaa aggtggccga ttctccttac    300
aactatatcc taacattacc atcaaaagga attagagcta ccttatcga tcccctgaac    360
gtatggttgg aggttccaga ggatgaaaca tcagtcatca aggaagttat tggtatgctc    420
cacaactctt cattaatcat tgatgacttc aagataatt ctccacttag aagaggaaag    480
ccatctaccc atacagtctt cggccctgcc caggctatca atactgctac ttacgttata    540
gttaaagcaa tcgaaaagat acaagacata gtgggaacag atgcattggc agatgttacg    600
ggtactatta caactatttt ccaaggtcag gccatggact tgtggtggac agcaaatgca    660
atcgttccat caatacagga atacttactt atggtaaacg ataaaaccgg tgctctcttt    720
agactgagtt tggagttgtt agctctgaat tccgaagcca gtatttctga ctctgcttta    780
gaaagtttat ctagtgctgt ttccttgcta ggtcaatact ccaaaatcag agacgactat    840
atgaacttga tcgataacaa gtatacagat cagaaaggct tctgcgaaga tcttgatgaa    900
ggcaagtact cactaacact tattcatgcc ctccaaactg attcatccga tctactgacc    960
aacatccttt caatgagaag agtgcaagga aagttaacgg cacaaaagag atgttggttc   1020
tggaaatga                                                           1029

SEQ ID NO: 22
Gibberella fujikuroi
MAEQQISNLL SMFDASHASQ KLEITVQMMD TYHYRETPPD SSSSEGGSLS RYDERRVSLP     60
LSHNAASPDI VSQLCFSTAM SSELNHRWKS QRLKVADSPY NYILTLPSKG IRGAFIDSLN    120
VWLEVPEDET SVIKEVIGML HNSSLIIDDF QDNSPLRRGK PSTHTVFGPA QAINTATYVI    180
VKAIEKIQDI VGHDALADVT GTITTIFQGQ AMDLWWTANA IVPSIQEYLL MVNDKTGALF    240
RLSLELLALN SEASISDSAL ESLSSAVSLL GQYFQIRDDY MNLIDNKYTD QKGFCEDLDE    300
GKYSLTLIHA LQTDSSDLLT NILSMRRVQG KLTAQKRCWF WK                      342

SEQ ID NO: 23
Artificial Sequence
atggaaaaga ctaaggagaa agcagaacgt atcttgctgg agccatacag atacttatta     60
caactaccag gaaagcaagt ccgttctaaa ctatcacaag cgttcaatca ctggttaaaa    120
gttcctgaag ataagttaca aatcattatt gaagtcacag aaatgctaca caatgcttct    180
ttactgatcg atgatataga ggattcttcc aaactgagaa gaggttttcc tgtcgctcat    240
tccatatacg gggtaccaag tgtaatcaac tcagctaatt acgtctactt cttgggattg    300
gaaaaagtat tgacattaga tcatccagac gctgtaaagt tattcaccag acaacttctt    360
gaattgcatc aaggtcaagg tttggatatc tattggagag acacttatac ttgcccaaca    420
gaagaggagt acaaagcaat ggttctacaa aagactggcg gtttgttcgg acttgccgtt    480
ggtctgatgc aacttttctc tgattacaag gaggacttaa gcctctgtt ggataccttg    540
ggcttgtttt tccagattag agatgactac gctaacttac attcaaagga atattcagaa    600
aacaaatcat tctgtgaaga tttgactgaa gggaagttta gtttccaac aatccacgcc    660
atttggtcaa gaccagaatc tactcaagtg caaaacattc tgcgtcagag aacagagaat    720
attgacatca aaagtatttg tgttcagtac tggaagatgt tggttctttt tgcttacaca    780
agacatacac ttagagaatt agaggcaaaa gcatacaagc aaatagaagc ctgtggaggc    840
aatccttctc tagtggcatt ggttaaacat ttgtccaaaa tgttcaccga ggaaaacaag    900
taa                                                                 903
```

TABLE 19-continued

Sequences disclosed herein.

SEQ ID NO: 24
Mus musculus
```
MEKTKEKAER ILLEPYRYLL QLPGKQVRSK LSQAFNHWLK VPEDKLQIII EVTEMLHNAS      60
LLIDDIEDSS KLRRGFPVAH SIYGVPSVIN SANYVYFLGL EKVLTLDHPD AVKLFTRQLL     120
ELHQGQGLDI YWRDTYTCPT EEEYKAMVLQ KTGGLFGLAV GLMQLFSDYK EDLKPLLDTL     180
GLFFQIRDDY ANLHSKEYSE NKSFCEDLTE GKFSFPTIHA IWSRPESTQV QNILRQRTEN     240
IDIKKYCVQY LEDVGSFAYT RHTLRELEAK AYKQIEACGG NPSLVALVKH LSKMFTEENK     300
```

SEQ ID NO: 25
Artificial Sequence
```
atggcaagat tctatttct taacgcacta ttgatggtta tctcattaca atcaactaca      60
gccttcactc cagctaaact tgcttatcca acaacaacaa cagctctaaa tgtcgcctcc    120
gccgaaactt ctttcagtct agatgaatac ttggcctcta agataggacc tatagagtct    180
gccttggaag catcagtcaa atccagaatt ccacagaccg ataagatctg cgaatctatg    240
gcctactctt tgatggcagg aggcaagaga attagaccag tgttgtgtat cgctgcatgt    300
gagatgttcg gtggatccca agatgtcgct atgcctactg ctgtggcatt agaaatgata    360
cacacaatgt ctttgattca tgatgatttg ccatccatgg ataacgatga cttgagaaga    420
ggtaaaccaa caaaccatgt cgttttcggc gaagatgtag ctattcttgc aggtgactct    480
ttattgtcaa cttccttcga gcacgtcgct agagaaacaa aaggagtgtc agcagaaaag    540
atcgtggatg ttatcgctag attaggcaaa tctgttggtg ccgagggcct tgctggcggt    600
caagttatgg acttagaatg tgaagctaaa ccaggtacca cattagacga cttgaaatgg    660
attcatatcc ataaaaccgc tacattgtta caagttgctg tagcttctgg tgcagttcta    720
ggtggtgcaa ctcctgaaga ggttgctgca tgcgagttgt ttgctatgaa tataggtctt    780
gcctttcaag ttgccgacga tatccttgat gtaaccgctt catcagaaga tttgggtaaa    840
actgcaggca aagatgaagc tactgataag acaacttacc caaagttatt aggattagaa    900
gagagtaagg catacgcaag acaactaatc gatgaagcca aggaaagttt ggctcctttt    960
ggagatagag ctgcccctt attggccatt gcagatttca ttattgatag aaagaattga   1020
```

SEQ ID NO: 26
Thalassiosira pseudonana
```
MARFYFLNAL LMVISLQSTT AFTPAKLAYP TTTTALNVAS AETSFSLDEY LASKIGPIES      60
ALEASVKSRI PQTDKICESM AYSLMAGGKR IRPVLCIAAC EMFGGSQDVA MPTAVALEMI    120
HTMSLIHDDL PSMDNDDLRR GKPTNHVVFG EDVAILAGDS LLSTSFEHVA RETKGVSAEK    180
IVDVIARLGK SVGAEGLAGG QVMDLECEAK PGTTLDDLKW IHIHKTATLL QVAVASGAVL    240
GGATPEEVAA CELFAMNIGL AFQVADDILD VTASSEDLGK TAGKDEATDK TTYPKLLGLE    300
ESKAYARQLI DEAKESLAPF GDRAAPLLAI ADFIIDRKN                           339
```

SEQ ID NO: 27
Artificial Sequence
```
atgcacttag caccacgtag agtccctaga ggtagaagat caccacctga cagagttcct      60
gaaagacaag gtgccttggg tagaagacgt ggagctggct ctactggctg tgcccgtgct    120
gctgctggtg ttcaccgtag aaggaggagg ggcgaggctg atccatcagc tgctgtgcat    180
agaggctggc aagccggtgg tggcaccggt ttgcctgatg aggtggtgtc taccgcagcc    240
gccttagaaa tgtttcatgc ttttgcttta atccatgatg atatcatgga tgatagtgca    300
actagaagag gctccccaac tgttcacaga gccctagctg atcgtttagg cgctgctctg    360
gacccagatc aggccggtca actaggagtt tctactgcta tcttggttgg agatctggct    420
ttgacatggt ccgatgaatt gttatacgct ccattgactc acatagact ggcagcagta    480
ctaccattgg taacagctat gagagctgaa accgttcagt gccaatatct tgatataact    540
agtgctagaa gacctgggac cgatacttct cttgcattga aatagccag atataagaca    600
gcagcttaca caatgaacg tccactgcac attggtgcag ccctggctgg ggcaagacca    660
gaactattag cagggctttc agcatacgcc ttgccagctg agaagccttc caattggca    720
tgacgctgc taggcgtctt cggtgatcca agacgtaagg ggaaacctga cctagatgat    780
cttagaggtg gaaagcatac tgtcttagtc gccttggca gagaacatgc cactccagaa    840
cagagacaca cattggatac attattggg acaccaggtc ttgatagaca aggcgcttca    900
agactaagat gcgtattggt agcaactggt gcaagaccg aagccgaaag acttattaca    960
gagagaagag atcaagcatt aactgcattg aacgcattaa cactgccacc tcctttagct   1020
gaggcattag caagattgac attagggtct acagctcatc ctgcctaa               1068
```

SEQ ID NO: 28
Streptomyces clavuligerus
```
MHLAPRRVPR GRRSPPDRVP ERQGALGRRR GAGSTGCARA AAGVHRRRGG GEADPSAAVH      60
RGWQAGGGTG LPDEVVSTAA ALEMFHAFAL IHDDIMDDSA TRRGSPTVHR ALADRLGAAL    120
DPDQAGQLGV STAILVGDLA LTWSDELLYA PLTPHRLAAV LPLVTAMRAE TVHGQYLDIT    180
SARRPGTDTS LALRIARYKT AAYTMERPLH IGAALAGARP ELLAGLSAYA LPAGEAFQLA    240
DDLLGVFGDP RRTGKPDLDD LRGGKHTVLV ALAREHATPE QRHTLDTLLG TPGLDRQGAS    300
RLRCVLVATG ARAEAERLIT ERRDQALTAL NALTLPPPLA EALARLTLGS TAHPA         355
```

SEQ ID NO: 29
Artificial Sequence
```
atgtcatatt tcgataacta cttcaatgag atagttaatt ccgtgaacga catcattaag      60
tcttacatct ctggcgacgt accaaaacta tacgaagcct cctaccattt gtttacatca    120
ggaggaaaga gactaagacc attgatcctt acaatttctt ctgatctttt cggtggacag    180
agagaaagag catactgc tggcgcagca atcgaagttt tgcacacatt cactttggtt    240
cacgatgata tcatggatca agataacatt cgtagaggtc ttcctactgt acatgtcaag    300
tatggcctac ctttggccat tttagctggt gacttattgc atgcaaaagc ctttcaattg    360
ttgactcagg cattgagagg tctaccatct gaaactatca tcaaggcgtt tgatatcttt    420
acaagatcta tcattatcat atcagaaggt caagctgtcg atatggaatt cgaagataga    480
attgatatca aggaacaaga gtatttggat atgatatctc gtaaaccgc tgccttattc    540
```

TABLE 19-continued

Sequences disclosed herein.

```
tcagcttctt cttccattgg ggcgttgata gctggagcta atgataacga tgtgagatta    600
atgtccgatt tcggtacaaa tcttgggatc gcatttcaaa ttgtagatga tatacttggt    660
ttaacagctg atgaaaaaga gctaggaaaa cctgttttca gtgatatcag agaaggtaaa    720
aagaccatat tagtcattaa gactttagaa ttgtgtaagg aagacgagaa aaagattgtg    780
ttaaaagcgc taggcaacaa gtcagcatca aaggaagagt tgatgagttc tgctgacata    840
atcaaaaagt actcattgga ttacgcctac aacttagctg agaaatacta caaaaacgcc    900
atcgattctc taaatcaagt ttcaagtaaa agtgatattc cagggaaggc attgaaatat    960
cttgctgaat tcaccatcag aagacgtaag taa                                 993

SEQ ID NO: 30
Sulfolobus acidocaldarius
MSYFDNYFNE IVNSVNDIIK SYISGDVPKL YEASYHLFTS GGKRLRPLIL TISSDLFGGQ     60
RERAYYAGAA IEVLHTFTLV HDDIMDQDNI RRGLPTVHVK YGLPLAILAG DLLHAKAFQL    120
LTQALRGLPS ETIIKAFDIF TRSIIIISEG QAVDMEFEDR IDIKEQEYLD MISRKTAALF    180
SASSSIGALI AGANDNDVRL MSDFGTNLGI AFQIVDDILG LTADEKELGK PVFSDIREGK    240
KTILVIKTLE LCKEDEKKIV LKALGNKSAS KEELMSSADI IKKYSLDYAY NLAEKYYKNA    300
IDSLNQVSSK SDIPGKALKY LAEFTIRRRK                                    330

SEQ ID NO: 31
Artificial Sequence
atggtcgcac aaactttcaa cctggatacc tacttatccc aaagacaaca acaagttgaa     60
gaggccctaa gtgctgctct tgtgccagct tatcctgaga gaatatacga agctatgaga    120
tactccctcc tggcaggtgg caaaagatta agacctatct tatgtttagc tgcttgcgaa    180
ttggcaggtg gttctgttga acaagccatg ccaactgcgt gtgcacttga aatgatccat    240
acaatgtcac taattcatga tgacctgcca gccatggata cgatgatttt cagaagagga    300
aagccaacta atcacaaggt gttcgggaaa gatatagcca tcttagcggg tgatgcgctt    360
ttagcttacg cttttgaaca tattgcttct caaacaaggg gagtaccacc tcaattggtg    420
ctacaagtta ttgctagaat cggacacgcc gttgctgcaa caggcctcgt tggaggccaa    480
gtcgtagacc ttgaatctga aggtaaagct atttccttag aaacattgga gtatattcac    540
tcacataaga ctggagcctt gctggaagca tcagttgtct caggcggtat tctcgcaggg    600
gcagatgaag agcttttggc cagattgtct cattacgcta gagatatagg cttggctttt    660
caaatcgtcg atgatatcct ggatgttact gctacatctg aacagttggg gaaaaccgct    720
ggtaaagacc aggcagccgc aaaggcaact tatccaagtc tattgggttt agaagcctct    780
agacagaaag cggaagagtt gattcaatct gctaaggaag ccttaagacc ttacggttca    840
caagcagagc cactcctagc gctggcagac ttcatcacac gtcgtcagca ttaa          894

SEQ ID NO: 32
Synechococcus sp.
MVAQTFNLDT YLSQRQQQVE EALSAALVPA YPERIYEAMR YSLLAGGKRL RPILCLAACE     60
LAGGSVEQAM PTACALEMIH TMSLIHDDLP AMDNDDFRRG KPTNHKVFGE DIAILAGDAL    120
LAYAFEHIAS QTRGVPPQLV LQVIARIGHA VAATGLVGGQ VVDLESEGKA ISLETLEYIH    180
SHKTGALLEA SVVSGGILAG ADEELLARLS HYARDIGLAF QIVDDILDVT ATSEQLGKTA    240
GKDQAAAKAT YPSLLGLEAS RQKAEELIQS AKEALRPYGS QAEPLLALAD FITRRQH      297

SEQ ID NO: 33
Artificial Sequence
atgaaaaccg ggtttatctc accagcaaca gtatttcatc acagaatctc accagcgacc     60
actttcagac atcacttatc acctgctact acaaactcta caggcattgt cgccttaaga    120
gacatcaact tcagatgtaa agcagttttct aaagagtact ctgatctgtt gcagaaagat    180
gaggcttctt tcacaaaatg ggacgatgac aaggtgaaag atcatcttga taccaacaaa    240
aacttatacc caaatgatga gattaaggaa tttgttgaat cagtaaaggc tatgttcggt    300
agtatgaatg acggggagat aaacgtctct gcatacgata ctgcatgggt tgctttggtt    360
caagtcgtcg atggatcagg tagtcctcag ttcccttcct ctttagaatg gattgccaat    420
aatcaattgt cagatggatc atggggagat catttgctgt tctcagctca cgatagaatc    480
atcaacacat tagcatgcgt tattgcactt acaagttgga atgttcatcc ttctaagtgt    540
gaaaaaggtt tgaattttct gagagaaaac atttgcaaat tagaagatga aaacgcagaa    600
catatgccaa ttggttttga agtaacattc ccatcactaa ttgatatcgc gaaaaagttg    660
aacattgaag tacctgagga tactccagca cttaaagaga tctacgcacg tagagatata    720
aagttaacta agatcccaat ggaagttctt cacaaggtac ctactacttt gttacattct    780
ttggaaggaa tgcctgattt ggagtgggaa aaactgttaa agctacaatg taaagatggt    840
agtttcttgt tttcccatc tagtaccgca ttcgccctaa tgcaaacaaa agatgagaaa    900
tgcttacagt atctaacaaa tatcgtcact aagttcaacg gtggcgtgcc taatgtgtac    960
ccagtcgatt gtgtttgaaca tattgggtt gttgatagac tgcagagatt ggggattgcc   1020
agatacttca aatcagagat aaaagattgt gtagagtata tcaataagta ctggaccaaa   1080
aatgaatttt gttgggctag aaatactcac gttcaagata tcgatgatac agccatggga   1140
ttcagagtgt tgagagcgca cggttatgac gtcactccag atgttttttag acaatttgaa   1200
aaagatggta aattcgtttg ctttgcaggg caatcaacac aagccgtgac aggaatgttt   1260
aacgtttaca gagcctctca aatgttgttc caggggagaa gaattttgga agatgccaaa   1320
aagttctctt acaattactt aaaggaaaag caaagtacga agaatggaaa ggataaatgg   1380
ataatcgcta aagatctacc tggtgaagtt ggtatgctct ggatatccc atggtatgct   1440
tccttaccaa gattggaaac tcgttattac cttgaacaat acggcggtga agatgatgtc   1500
tggataggca agacattata cagaatgggt tacgtgtcca ataacacata tctagaaatg   1560
gcaaagctgg attacaataa ctatgttgca gtccttcaat tagaatggta cacaatacaa   1620
caatggtacg tcgatattgg tatagagaag ttcgaatctg caacacatcaa gtcagtcctg   1680
```

TABLE 19-continued

Sequences disclosed herein.

SEQ ID NO: 34
*Stevia rebaudiana*
```
MKTGFISPAT VFHHRISPAT TFRHHLSPAT TNSTGIVALR DINFRCKAVS KEYSDLLQKD    60
EASFTKWDDD KVKDHLDTNK NLYPNDEIKE FVESVKAMFG SMNDGEINVS AYDTAWVALV   120
QDVDGSGSPQ FPSSLEWIAN NQLSDGSWGD HLLFSAHDRI INTLACVIAL TSWNVHPSKC   180
EKGLNFLREN ICKLEDENAE HMPIGFEVTF PSLIDIAKKL NIEVPEDTPA LKEIYARRDI   240
KLTKIPMEVL HKVPTTLLHS LEGMPDLEWE KLLKLQCKDG SFLFSPSSTA FALMQTKDEK   300
CLQYLTNIVT KFNGGVPNVY PVDLFEHIWV VDRLQRLGIA RYFKSEIKDC VEYINKYWTK   360
NGICWARNTH VQDIDDTAMG FRVLRAHGYD VTPDVFRQFE KDGKFVCFAG QSTQAVTGMF   420
NVYRASQMLF PGERILEDAK KFSYNYLKEK QSTNELLDKW IIAKDLPGEV GYALDIPWYA   480
SLPRLETRYY LEQYGGEDDV WIGKTLYRMG YVSNNTYLEM AKLDYNNYVA VLQLEWYTIQ   540
QWYVDIGIEK FESDNIKSVL VSYYLAAASI FEPERSKERI AWAKTTILVD KITSIFDSSQ   600
SSKEDITAFI DKFRNKSSSK KHSINGEPWH EVMVALKKTL HGFALDALMT HSQDIHPQLH   660
QAWEMWLTKL QDGVDVTAEL MVQMINMTAG RWVSKELLTH PQYQRLSTVT NSVCHDITKL   720
HNFKENSTTV DSKVQELVQL VFSDTPDDLD QDMKQTFLTV MKTFYYKAWC DPNTINDHIS   780
KVFEIVI                                                            787
```

SEQ ID NO: 35
Artificial Sequence
```
atgcctgatg cacacgatgc tccacctcca caaataagac agagaacact agtagatgag    60
gctacccaac tgctaactga gtccgcagaa gatgcatggg gtgaagtcag tgtgtcagaa   120
tacgaaacag caaggctagt tgcccatgct acatggttag gtggacacgc cacaagagtg   180
gccttccttc tggagagaca acacgaagac gggtcatggg gtccaccagg tggatatagg   240
ttagtcccta cattatctgc tgttcacgca ttattgacat gtcttgcctc tcctgctcag   300
gatcatggcg ttccacatga tagactttta agagctgttg acgcaggctt gactgccttg   360
agaagattgg ggacatctga ctccccacct gatactatag cagttgagct ggttatccca   420
tctttgctag agggcattca acacttactg gaccctgctc atcctcatag tagaccagcc   480
ttctctcaac ataggagctc tcttgttttgt cctggtggac tagatgggag aactctagga   540
gctttgagat cacacgccgc agcaggtaca ccagtaccag gaaaagtctg gcacgcttcc   600
gagacttttgg gcttgagtac cgaagctgct tctcacttgc aaccagccca aggtataatc   660
ggtggctctg ctgctgccac agcaacatgg ctaaccaggg ttgcaccatc tcaacagtca   720
gattctgcca gaagataccct tgaggaatta caacacagat actctggccc agttccttcc   780
attacccccta tcacatactt cgaaagagca tggttattga caattttgc agcagccggt   840
gttccttgtg aggctccagc tgcttttgtt gattccttag aagcagcact tacaccacaa   900
ggtgctcctg ctggagcagg attgcctcca gatgctgatg atacagccgc tgtgttgctt   960
gcattggcaa cacatgggag aggtagaaga ccagaagtac tgatggatta caggactgac  1020
gggtatttcc aatgctttat tgggggaaagg actccatcaa tttcaacaaa cgctcacgta  1080
ttggaaacat tagggcatca tgtgcccaaa catccacaag atagagccag atacggatca  1140
gccatggata ccgcatcagc ttggctgctg gcagctcaaa agcaagatgg ctcttggtta  1200
gataaatggc atgcctcacc atactacgct actgtttgtt gcacacaagc cctagccgct  1260
catgcaagtc ctgcaactgc caagctaga cagagagctg tcagatgggg tttagccaca  1320
caaagatccg atggcggttg gggtctatgg cattcaactg ttgaagagac tgcttatgcc  1380
ttacagatct tggccccacc ttctggtggt ggcaatatcc cagtccaaca agcacttact  1440
agaggcagag caagattgtg tggagccttg ccactgactc ctttatggca tgataaggat  1500
ttgtatactc cagtaagagt agtcagagct gccagagctg ctgctctgta cactaccaga  1560
gatctattgt taccaccatt gtaa                                          1584
```

SEQ ID NO: 36
*Streptomyces clavuligerus*
```
MPDAHDAPPP QIRQRTLVDE ATQLLTESAE DAWGEVSVSE YETARLVAHA TWLGGHATRV    60
AFLLERQHED GSWGPPGGYR LVPTLSAVHA LLTCLASPAQ DHGVPHDRLL RAVDAGLTAL   120
RRLGTSDSPP DTIAVELVIP SLLEGIQHLL DPAHPHSRPA FSQHRGSLVC PGGLDGRTLG   180
ALRSHAAAGT PVPGKVWHAS ETLGLSTEAA SHLQPAQGII GGSAAATATW LTRVAPSQQS   240
DSARRYLEEL QHRYSGPVPS ITPITYFERA WLLNNFAAAG VPCEAPAALL DSLEAALTPQ   300
GAPAGAGLPP DADDTAAVLL ALATHGRGRR PEVLMDYRTD GYFQCFIGER TPSISTNAHV   360
LETLGHHVAQ HPQDRARYGS AMDTASAWLL AAQKQDGSWL DKWHASPYYA TVCCTQALAA   420
HASPATAPAR QRAVRWVLAT QRSDGGWGLW HSTVEETAYA LQILAPPSGG GNIPVQQALT   480
RGRARLCGAL PLTPLWHDKD LYTPVRVVRA ARAAALYTTR DLLLPPL                 527
```

SEQ ID NO: 37
Artificial Sequence
```
atgaacgccc tatccgaaca cattttgtct gaattgagaa gattattgtc tgaaatgagt    60
gatggcggat ctgttggtcc atctgtgtat gatacggccc aggccctaag attccacggt   120
aacgtaacag gtagacaaga tgcatatgct tggttgatcg cccagcaaca agcagatgga   180
ggttggggct ctgccgactt tccactcttt agacatgtca caacatgggc tgcacttctc   240
gcattacaaa gagctgatcc acttcctggc gcagcagacg cagttcagac cgcaacaaga   300
ttcttgcaaa gacaaccaga tccatacgct catgccgttc ctgaggatgc ccctattggt   360
gctgaactga tcttgcctca gttttgtgga gaggctgctt ggtgttggg aggtgtggcc   420
ttccctagac acccagccct attaccatta agacaggctt gtttagtcaa actgggtgca   480
gtcgccatgt tgccttcagg acacccattg ctccactcct gggaggcatg gggtacttct   540
ccaacaacag cctgtccaga cgatgatggt tctataggta tctccaccag cgctacagcc   600
gcctggagag cccaggctgt gaccagaggc tcaactcctc aagtgggcag agctgacgca   660
tactacaaa tggctcaag agcaacgaga tcaggcatag aaggagtctt ccctaatgtt   720
tggcctataa acgtattcga accatgctgg tcactgtaca ctctccatct tgccggtctg   780
ttcgcccatc cagcactggc tgaggctgta agagttatcg ttgctcaact tgaagcaaga   840
ttgggagtgc atggcctcgg accagcttta catttttgctg ccgacgctga tgatactgca   900
gttgcctat gcgttctgca tttggctggc agagatcctg cagttgacgc attgagacat   960
tttgaaattg gtgagctctt tgttacattc ccaggagaga gaaatgctag tgtctctacg  1020
```

TABLE 19-continued

Sequences disclosed herein.

```
aacattcacg ctcttcatgc tttgagattg ttaggtaaac cagctgccgg agcaagtgca  1080
tacgtcgaag caaatagaaa tccacatggt ttgtgggaca acgaaaaatg gcacgtttca  1140
tggctttatc caactgcaca cgccgttgca gctctagctc aaggcaagcc tcaatggaga  1200
gatgaaagag cactagccgc tctactacaa gctcaaagag atgatggtgg ttggggagct  1260
ggtagaggat ccactttcga ggaaaccgcc tacgctcttt tcgctttaca cgttatggac  1320
ggatctgagg aagccacagg cagaagaaga atcgctcaag tcgtcgcaag agccttagaa  1380
tggatgctag ctagacatgc cgcacatgga ttaccacaaa caccactctg gattggtaag  1440
gaattgtact gtcctactag agtcgtaaga gtagctgagc tagctggcct gtggttagca  1500
ttaagatggg gtagaagagt attagctgaa ggtgctggtg ctgcacctta a            1551
```

SEQ ID NO: 38
Bradyrhizobium japonicum

```
MNALSEHILS ELRRLLSEMS DGGSVGPSVY DTAQALRFHG NVTGRQDAYA WLIAQQQADG   60
GWGSADFPLF RHAPTWAALL ALQRADPLPG AADAVQTATR FLQRQPDPYA HAVPEDAPIG  120
AELILPQFCG EAAWLLGGVA FPRRHPALLPL RQACLVKLGA VAMLPSGHPL LHSWEAWGTS  180
PTTACPDDDG SIGISPAATA AWRAQAVTRG STPQVGRADA YLQMASRATR SGIEGVFPNV  240
WPINVFEPCW SLYTLHLAGL FAHPALAEAV RVIVAQLEAR LGVHGLGPAL HFAADADDTA  300
VALCVLHLAG RDPAVDALRH FEIGELFVTF PGERNASVST NIHALHALRL LGKPAAGASA  360
YVEANRNPHG LWDNEKWHVS WLYPTAHAVA ALAQGKPQWR DERALAALLQ AQRDDGGWGA  420
GRGSTFEETA YALFALHVMD GSEEATGRRR IAQVVARALE WMLARHAAHG LPQTPLWIGK  480
ELYCPTRVVR VAELAGLWLA LRWGRRVLAE GAGAAP                            516
```

SEQ ID NO: 39
Artificial Sequence

```
atggttttgt cttcttcttg tactacagta ccacacttat cttcattagc tgtcgtgcaa   60
cttggtcctt ggagcagtag gattaaaaag aaaaccgata ctgttgcagt accagccgct  120
gcaggaaggt ggagaagggc cttggctaga gcacagcaca catcagaatc cgcagctgtc  180
gcaaagggca gcagtttgac ccctatagtg agaactgacg ctgagtcaag gagaacaaga  240
tggccaaccg atgacgatga cgccgaacct ttagtggatg agatcaggc aatgcttact   300
tccatgtctg atggtgacat ttccgtgagc gcatacgata cagcctgggt cggattggtt  360
ccaagattag acggcggtga aggtcctcaa tttccagcag ctgtgagatg gataagaaat  420
aaccagttgc ctgacggaag ttggggcgat gccgactat tctctgccta tgacaggctt   480
atcaataccc ttgcctgcgt tgtaactttg acaaggtggt ccctagaacc agagatgaga  540
ggtagaggac tatcttttt ggtaggaac atgtggaaat tagcaactga agatgaaagag   600
tcaatgccta ttggcttcga attagcattt ccatctttga tagagcttgc taagagccta  660
ggtgtccatg acttccctta tgatcaccag gccctacaag gaatctactc ttcaagagag  720
atcaaaatga gaggattcc aaaagaagtg atgcataccg ttccaacatc aatattgcac   780
agtttggagg gtatgcctgg cctagattgg gctaaactac ttaaactaca gagcagcgac  840
ggaagttttt tgttctcacc agctgccact gcatatgctt taatgaatac cggagatgac  900
aggtgtttta gctacatcga tagaacagta aagaaattca aggcggcgt ccctaatgtt   960
tatccagtgg atctatttga acatatttgg gccgttgata gacttgaaag attaggaatc  1020
tccaggtact tccaaaagga gatcgaacaa tgcatggatt atgtaaacag gcattggact  1080
gaggacggta tttgttgggc aaggaactct gatgtcaaag aggtggacga cacagctatg  1140
gcctttagac ttcttaggtt gcacggctac agcgtcagtc ctgatgtgtt taaaaacttc  1200
gaaaaggacg gtgaattttt cgcatttgtc ggacagtcta atcaagctgt taccggtatg  1260
tacaacttaa acagagcaag ccagatatcc ttcccaggcg aggatgtgct tcatagagct  1320
ggtgccttct catatgagtt cttgaggaga aaagaagcag agggagcttt gagggacaag  1380
tggatcattt ctaaagatct acctggtgaa gtttgtgtata ctttggattt tccatggtac  1440
ggcaacttac ctagagtcga ggccagagac tacctagagc aatacggagg tggtgatgac  1500
gtttggattg gcaagacatt gtataggatg ccacttgtaa acaatgatgt atatttggaa  1560
ttggcaagaa tggatttcaa ccactgccag gctttgcatc agttagagtg caaggacta   1620
aaaagatggt atactgaaaa taggttgatg gactttggtg tcgcccaaga agatgccctt  1680
agagcttatt ttcttgcagc cgcatctgtt tacgagcctt gtagagctgc cgagaggctt  1740
gcatgggcta gagccgcaat actagctaac gccgtgagca cccacttaag aaatagccca  1800
tcattcagag aaaggttaga gcattctctt aggtgtagac ctagtgaaga gacagatggc  1860
tcctggttta actcctcaag tggctctgat gcagttttag taaaggctgt cttaagactt  1920
actgattcat tagccaggga agcacagcca atccatggag gtgacccaga agatattata  1980
cacaagttgt taagatctgc ttgggccgag tgggttaggg aaaaggcaga cgctgccgat  2040
agcgtgtgca atggtagttc tgcagtagaa caagagggat caagaatggt ccatgataaa  2100
cagacctgtc tattattggc tagaatgatc gaaatttctg ccggtagggc agctggtgaa  2160
gcagccagtg aggacggcga tagaagaata attcaattaa ggagctccat ctgcgacagt  2220
cttaagcaaa aaatgctagt ttcacaggac cctgaaaaaa atgaagagat gatgtctcac  2280
gtggatgacg aattgaagtt gaggattaga gagttcgttc aatatttgct tagactaggt  2340
gaaaaaaaga ctggatctag cgaaaccagg caaacatttt taagtatagt gaaatcatgt  2400
tactatgctg ctcattgccc acctcatgtc gttgatagac acattagtag agtgattttc  2460
gagccagtaa gtgccgcaaa gtaaccgcgg                                   2490
```

SEQ ID NO: 40
Zea mays

```
MVLSSSCTTV PHLSSLAVVQ LGPWSSRIKK KTDTVAVPAA AGRWRRALAR AQHTSESAAV   60
AKGSSLTPIV RTDAESRRTR WPTDDDDAEP LVDEIRAMLT SMSDGDISVS AYDTAWVGLV  120
PRLDGGEGPQ FPAAVRWIRN NQLPDGSWGD AALFSAYDRL INTLACVVTL TRWSLEPEMR  180
GRGLSFLGRN MWKLATEDEE SMPIGFELAF PSLIELAKSL GVHDFPYDHQ ALQGIYSSRE  240
IKMKRIPKEV MHTVPTSILH SLEGMPGLDW AKLLKLQSSD GSFLFSPAAT AYALMNTGDD  300
RCFSYIDRTV KKFNGGVPNV YPVDLFEHIW AVDRLERLGI SRYFQKEIEQ CMDYVNRHWT  360
EDGICWARNS DVKEVDDTAM AFRLLRLHGY SVSPDVFKNF EKDGEFFAFV GQSNQAVTGM  420
YNLNRASQIS FPGEDVLHRA GAFSYEFLRR KEAEGALRDK WIISKDLPGE VVYTLDFPWY  480
GNLPRVEARD YLEQYGGGDD VWIGKTLYRM PLVNNDVYLE LARMDFNHCQ ALHQLEWQGL  540
```

TABLE 19-continued

Sequences disclosed herein.

```
                     KRWYTENRLM  DFGVAQEDAL  RAYFLAAASV  YEPCRAAERL  AWARAAILAN  AVSTHLRNSP   600
                     SFRERLEHSL  RCRPSEETDG  SWFNSSSGSD  AVLVKAVLRL  TDSLAREAQP  IHGGDPEDII   660
                     HKLLRSAWAE  WVREKADAAD  SVCNGSSAVE  QEGSRMVHDK  QTCLLLARMI  EISAGRAAGE   720
                     AASEDGDRRI  IQLTGSICDS  LKQKMLVSQD  PEKNEEMMSH  VDDELKLRIR  EFVQYLLRLG   780
                     EKKTGSSETR  QTFLSIVKSC  YYAAHCPPHV  VDRHISRVIF  EPVSAAK                  827

SEQ ID NO: 41
Artificial Sequence
                     cttcttcact  aaatacttag  acagagaaaa  cagagctttt  taaagccatg  tctcttcagt    60
                     atcatgttct  aaactccatt  ccaagtacaa  cctttctcag  ttctactaaa  acaacaatat   120
                     cttcttcttt  ccttaccatc  tcaggatctc  tctcaatgtt  cgctagagac  aaatccagaa   180
                     gcggttccat  acattgttca  aagcttcgaa  ctcaagaata  cattaattct  caagaggttc   240
                     aacatgattt  gcctctaata  catgagtggc  aacagcttca  aggagaagat  gctcctcaga   300
                     ttagtgttgg  aagtaatagt  aatgcattca  aagaagcagt  gaagagtgtg  aaaacgatct   360
                     tgagaaacct  aacggacggg  gaaattacga  tatcggctta  cgatacagct  tgggttgcat   420
                     tgatcgatgc  cggagataaa  actccggcgt  ttccctccgc  cgtgaaatgg  atcgccgaga   480
                     accaactttc  cgatggttct  tggggagatg  cgtatctctt  ctcttatcat  gatcgtctca   540
                     tcaataccct  tgcatgcgtc  gttgctctaa  gatcatggaa  tctctttcct  catcaatgca   600
                     acaaaggaat  cacgttttc   cgggaaaata  ttgggaagct  agaagacgaa  aatgatgagc   660
                     atatgccaat  cggattcgaa  gtagcattcc  catcgttgct  tgagatagct  cgaggaataa   720
                     acattgatgt  accgtacgat  tctccggtct  aaaagatat   atacgccaag  aaagagctaa   780
                     agcttacaag  gataccaaaa  gagataatgc  acaagatacc  aacaacattg  ttgcatagtt   840
                     tggaggggat  gcgtgattta  gattgggaaa  agctcttgaa  acttcaatct  caagacggat   900
                     ctttcctctt  ctctccttcc  tctaccgctt  ttgcattcat  gcagacccga  gacagtaact   960
                     gcctcgagta  tttgcgaaat  gccgtcaaac  gtttcaatgg  aggagttccc  aatgtctttc  1020
                     ccgtggatct  tttcgagcac  atatggatag  tggatcggtt  acaacgttta  gggatatcga  1080
                     gatactttga  agaagagatt  aaagagtgtc  ttgactatgt  ccacagatat  tggaccgaca  1140
                     atggcatatg  ttgggctaga  tgttcccatg  tccaagacat  cgatgataca  gccatggcat  1200
                     ttaggctctt  aagacaacat  ggataccaag  tgtccgcaga  tgtattcaag  aactttgaga  1260
                     aagagggaga  gttttctgc   tttgtgggc   aatcaaacca  agcagtaacc  ggtatgttca  1320
                     acctataccg  ggcatcacaa  ttggcgtttc  caagggaaga  gatattgaaa  aacgccaaag  1380
                     agttttctta  taattatctg  ctagaaaaac  gggaagagag  ggagttgatt  gataagtgga  1440
                     ttataatgaa  agacttacct  ggcgagattg  ggtttgcgtt  agagattcca  tggtacgcaa  1500
                     gcttgcctcg  agtagagacg  agattctata  ttgatcaata  tggtggagaa  aacgacgttt  1560
                     ggattggcaa  gactctttat  aggatgccat  acgtgaacaa  taatggatat  ctggaattag  1620
                     caaaacaaga  ttacaacaat  tgccaagctc  agcatcagct  cgaatgggac  atattccaaa  1680
                     agtggtatga  agaaaatagg  ttaagtgagt  ggggtgtgcg  cagaagtgag  cttctcgagt  1740
                     gttactactt  agcggctgca  actatatttg  aatcagaaag  gtcacatgag  agaatggttt  1800
                     gggctaagtc  aagtgtattg  gttaaagcca  tttcttcttc  ttttgggaa   tcctctgact  1860
                     ccagaagaag  cttctccgat  cagtttcatg  aatacattgc  aaatgctcga  cgaagtgatc  1920
                     atcactttaa  tgacaggaac  atgagattgg  accgaccagg  atcggttcag  gccagtcggc  1980
                     ttgccggagt  gttaatcggg  actttgaatc  aaatgtcttt  tgaccttttc  atgtctcatg  2040
                     gccgtgacgt  taacaatctc  ctctatctat  cgtggggaga  ttggatggaa  aaatggaaac  2100
                     tatatggaga  tgaaggagaa  ggagagctca  tggtgaagat  gataattcta  atgaagaaca  2160
                     atgacctaac  taacttcttc  acccacactc  acttcgttcg  tctcgcggaa  atcatcaatc  2220
                     gaatctgtct  tcctcgccaa  tacttaaagg  caaggagaaa  cgatgagaag  gagaagacaa  2280
                     taaagagtat  ggagaaggag  atggggaaaa  tggttgagtt  agcattgtcg  gagagtgaca  2340
                     catttcgtga  cgtcagcatc  acgtttcttg  atgtagcaaa  agcattttac  tacttttgct  2400
                     tatgtggcga  tcatctccaa  actcacatct  ccaaagtctt  gtttcaaaaa  gtctagtaac  2460
                     ctcatcatca  tcatcgatcc  attaacaatc  agtggatcga  tgtatccata  gatgcgtgaa  2520
                     taatatttca  tgtagagaag  gagaacaaat  tagatcatgt  agggttatca              2570

SEQ ID NO: 42
Arabidopsis thaliana
                     MSLQYHVLNS  IPSTTFLSST  KTTISSSFLT  ISGSPLNVAR  DKSRSGSIHC  SKLRTQEYIN    60
                     SQEVQHDLPL  IHEWQQLQGE  DAPQISVGSN  SNAFKEAVKS  VKTILRNLTD  GEITISAYDT   120
                     AWVALIDAGD  KTPAFPSAVK  WIAENQLSDG  SWGDAYLFSY  HDRLINTLAC  VVALRSWNLF   180
                     PHQCNKGITF  FRENIGKLED  ENDEHMPIGF  EVAFPSLLEI  ARGINIDVPY  DSPVLKDIYA   240
                     KKELKLTRIP  KEIMHKIPTT  LLHSLEGMRD  LDWEKLLKLQ  SQDGSFLFSP  SSTAFAFMQT   300
                     RDSNCLEYLR  NAVKRFNGGV  PNVFPVDLFE  HIWIVDRLQR  LGISRYFEEE  IKECLDYVHR   360
                     YWTDNGICWA  RCSHVQDIDD  TAMAFRLLRQ  HGYQVSADVF  KNFEKEGEFF  CFVGQSNQAV   420
                     TGMFNLYRAS  QLAFPREEIL  KNAKEFSYNY  LLEKREREEL  IDKWIIMKDL  PGEIGFALEI   480
                     PWYASLPRVE  TRFYIDQYGG  ENDVWIGKTL  YRMPYVNNNG  YLELAKQDYN  NCQAQHQLEW   540
                     DIFQKWYEEN  RLSEWGVRRS  ELLECYYLAA  ATIFESERSH  ERMVWAKSSV  LVKAISSSFG   600
                     ESSDSRRSFS  DQFHEYIANA  RRSDHHFNDR  NMRLDRPGSV  QASRLAGVLI  GTLNQMSFDL   660
                     FMSHGRDVNN  LLYLSWGDWM  EKWKLYGDEG  EGELMVKMII  LMKNNDLTNF  FTHTHFVRLA   720
                     EIIINRICLPR  QYLKARRNDE  KEKTIKSMEK  EMGKMVELAL  SESDTFRDVS  ITFLDVAKAF   780
                     YYFALCGDHL  QTHISKVLFQ  KV                                                  802

SEQ ID NO: 43
Artificial Sequence
                     atgaatttga  gtttgtgtat  agcatctcca  ctattgacca  aatctaatag  accagctgct    60
                     ttatcagcaa  ttcatacagc  tagtacatcc  catggtggcc  aaaccaacca  tacgaatctg   120
                     ataatcgata  cgaccaagga  gagaatacaa  aaacaattca  aaaatgttga  aatttcagtt   180
                     tcttcttatg  atactgcgtg  ggttgccatg  gttccatcac  ctaattctcc  aaagtctcca   240
                     tgtttcccag  aatgtttgaa  ttggctgatt  acaaccagt   tgaatgatgg  atcttggggt   300
                     ttagtcaatc  acacgcacaa  tcacaaccat  ccacttttga  aagattcttt  atcctcaact   360
                     ttggcttgca  tcgtggccct  aaagagatgg  aacgtaggtg  aggatcagat  taacaagggg   420
```

TABLE 19-continued

Sequences disclosed herein.

```
cttagtttca ttgaatctaa cttggcttcc gcgactgaaa aatctcaacc atctccaata   480
ggattcgata tcatctttcc aggtctgtta gagtacgcca aaaatctaga tatcaactta   540
ctgtctaagc aaactgattt ctcactaatg ttacacaaga gagaattaga acaaaagaga   600
tgtcattcaa acgaaatgga tggttaccta gcttatatct ctgaaggtct tggtaatctt   660
tacgattgga atatggtgaa aaagtaccag atgaaaaatg gctcagtttt caattcccct   720
tctgcaactg cggcagcatt cattaaccat caaaatccag gatgcctgaa ctatttgaat   780
tcactactag acaaattcgg caacgcagtt ccaactgtat accctcacga tttgtttatc   840
agattgagta tggtggatac aattgaaaga cttggtatat cccaccactt tagagtcgag   900
atcaaaaatg ttttggatga gacataccgt tgttgggtgg agagagatga acaaatcttt   960
atggatgttg tgacgtgcgc gttggccttt agattgttgc gtattaacgg ttacgaagtt  1020
agtccagatc cacttgccga aattacaaac gaattagctt taaaggatga atacgccgtc  1080
cttgaaacat atcatgcgtc acatatcctt taccaagagg acttatcatc tggaaaacaa  1140
attcttaaat ctgctgattt cctgaaggaa atcatatcca ctgatagtaa tagactgtcc  1200
aaactgatcc ataagaggt tgaaaatgca cttaagttcc ctattaacac cggcttagaa  1260
cgtattaaca caagacgtaa catccagctt tacaacgtag acaatactag aatcttgaaa  1320
accacttacc attcttccaa catatcaaac actgattacc taagattagc tgttgaagat  1380
ttctacacat gtcagtctat ctatagaaaa gagctgaaag gattagagag atgggtcgtt  1440
gagaataagc tagatcaatt gaaatttgcc agacaaaaga cagcttattg ttacttctca  1500
gttgccgcca ctttatcaag tccagaattg tcagatgcac gtatttcttg ggctaaaaac  1560
ggaattttga caactgttgt tgatgatttc tttgatattg gcgggacaat cgacgaattg  1620
acaaacctga ttcaatgcgt tgaaaagtgg aatgtcgatg tcgataaaga ctgttgctca  1680
gaacatgtta aatactgtt cttggctctg aaagatgcta tctgttggat cggggatgag  1740
gctttcaaat ggcaagctag agatgtgacg tctcacgtca ttcaaacctg gctagaactg  1800
atgaactcta tgttgagaga agcaatttgg actagagatg catacgttcc tacattaaac  1860
gagtatatgg aaaacgctta tgtctccttt gctttgggtc ctatcgttaa gcctgccata  1920
tactttgtag gaccaaagct atccgaggaa atcgtcgaat catcagaata ccataacttg  1980
ttcaagttaa tgtccacaca aggcagatta cttaatgata ttcattcttt caaaagagag  2040
tttaaggaag gaaagttaaa tgctgttgct ctgcatcttt ctaatggcga aagtggtaaa  2100
gtcgaagagg aagtagttga ggaaatgatg atgatcaaaa acaagag aaaggagttg  2160
atgaaactaa tcttcgaaga aacggttca attgttccta gagcatgtaa ggatgcattt  2220
tggaacatgt gtcatgtgct aaactttttc tacgcaaacg acgatggttt tactgggaac  2280
acaatactag atacagtaaa agacatcata tacaacccct tggtcttagt aaacgaaaac  2340
gaggagcaaa gataa                                                   2355

SEQ ID NO: 44
Stevia rebaudiana
MNLSLCIASP LLTKSNRPAA LSAIHTASTS HGGQTNPTNL IIDTTKERIQ KQFKNVEISV    60
SSYDTAWVAM VPSPNSPKSP CFPECLNWLI NNQLNDGSWG LVNHTHNHNH PLLKDSLSST   120
LACIVALKRW NVGEDQINKG LSFIESNLAS ATEKSQPSPI GFDIIFPGLL EYAKNLDINL   180
LSKQTDFSLM LHKRELEQKR CHSNEMDGYL AYISEGLGNV PTVYPHDLFI RLSMVDTIER   240
SATAAAFINH QNPGCLNYLN SLLDKFGNAV PTVYPHDLFI RLSMVDTIER LGISHHFRVE   300
IKNVLDETYR CWVERDEQIF MDVVTCALAF RLLRINGYEV SPDPLAEITN ELALKDEYAA   360
LETYHASHIL YQEDLSSGKQ ILKSADFLKE IISTDSNRLS KLIHKEVENA LKFPINTGLE   420
RINTRRNIQL YNVDNTRILK TTYHSSNISN TDYLRLAVED FYTCQSIYRE ELKGLERWVV   480
ENKLDQLKFA RQKTAYCYFS VAATLSSPEL SDARISWAKN GILTTVVDDF FDIGGTIDEL   540
TNLIQCVEKW NVDVDKDCCS EHVRILFLAL KDAICWIGDE AFKWQARDVT SHVIQTWLEL   600
MNSMLREAIW TRDAYVPTLN EYMENAYVSF ALGPIVKPAI YFVGPKLSEE IVESSEYHNL   660
FKLMSTQGRL LNDIHSFKRE FKEGKLNAVA LHLSNGESGK VEEEVVEEMM MMIKNKRKEL   720
MKLIFEENGS IVPRACKDAF WNMCHVLNFF YANDDGFTGN TILDTVKDII YNPLVLVNEN   780
EEQR                                                               784

SEQ ID NO: 45
Artificial Sequence
atgaatctgt ccctttgtat agctagtcca ctgttgacaa atcttctag accaactgct    60
ctttctgcaa ttcatactgc cagtactagt catggaggtc aaacaaaccc aacaaatttg   120
ataatcgata ctactaagga gagaatccaa aagctattca aaaatgttga atctcagta    180
tcatcttatg acaccgcatg ggttgcaatg gtgccatcac ttaattcccc aaaaagtcca   240
tgttttccag agtgcttgaa ttggttaatc aataatcagt taaacgatgg ttcttggggt   300
ttagtcaacc acactcataa ccacaatcat ccattattga aggactcttt atcatcaaca   360
ttagcctgta ttgttgcatt gaaagatggg aatgtaggtg aagatcaaat caacaagggt   420
ttatcattca tagaatccaa tctagcttct gctaccgaca aatcacaacc atctccaatc   480
gggttcgaca taatcttccc tggtttgctg gagtatgcca aaaaccttga tatcaactta   540
ctgtctaaac aaacagattt ctctttgatg ctacacaaaa gagagttaga gcagaaaaga   600
tgccattcta acgaaattga cgggtactta gcatatatct cagaaggttt gggtaatttg   660
tatgactgga acatggtgaa aaagtatcag atgaaaaatg gatccgtatt caattctcct   720
tctgcaactg ccgcagcatt cattaatcat caaaacctg ggtgtcttaa ctacttgaac   780
tcactattag ataagtttgg aaatgcagtt ccaacagtct atccttttgga cttgtacatc   840
agattatcta tggttgacac tatagagaga ttaggtatt ctcatcattt cagagttgag   900
atcaaaaatg ttttggacga gacataaga tgttgggtg aaagagatga gcaaatcttt   960
atggatgtcg tgacctgcgc tctggccttt agattgctaa ggatacacgg atacaaagta  1020
tctcctgatc aactggctga gattacaaac gaactggctt tcaaagacga atacgccgca  1080
ttagaaacat accatgcatc ccaaatactt taccaggaag acctaagttc aggaaaacaa  1140
attcttgaagt ctgcagattt cctgaaaggc atttctgcta cagtagtaa taggttgtct  1200
aaattgatac acaaggaagt gaaaacgaa ctaagtttc ctattaacac tggttttagag  1260
agaatcaata ctaggagaaa cattcagctg tacaacgtag ataatacaag gattcttaag  1320
accacctacc atagttcaaa catttccaac acctattact taagattagc tgtcgaagac  1380
ttttacactt gtcaatcaat ctacagagag gagttaaagg gcctagaaag atgggtagtt  1440
caaaacaagt tggatcaact gaagtttgct agacagaaga cagcatactg ttatttctct  1500
```

TABLE 19-continued

Sequences disclosed herein.

```
gttgctgcta ccctttcatc cccagaattg tctgatgcca gaataagttg ggccaaaaat   1560
ggtattctta caactgtagt cgatgatttc tttgatattg gaggtactat tgatgaactg   1620
acaaatctta ttcaatgtgt tgaaaagtgg aacgtggatg tagataagga ttgctgcagt   1680
gaacatgtga gaatactttt cctggctcta aaagatgcaa tatgttggat tggcgacgag   1740
gccttcaagt ggcaagctag agatgttaca tctcatgtca tccaaacttg gcttgaactg   1800
atgaactcaa tgctaagaga agcaatctgg acaagagatg catacgttcc aacattgaac   1860
gaatacatgg aaaacgctta cgtctcattt gccttggctc ctattgttaa gccagccata   1920
tactttgttg ggccaaagtt atccgaagag attgttgagt cttccgaata tcataaccta   1980
ttcaagttaa tgtcaacaca aggcagactt ctgaacagta tccactcctt caaaagagaa   2040
ttcaaggaag gtaagctaaa cgctgttgct ttgcacttgt ctaatggtga atctggcaaa   2100
gtggaagagg aagtcgttga ggaaatgatg atgatgataa aaaacaagag aaaggaattg   2160
atgaaattga ttttcgagga aaatggttca atcgtaccta gagcttgtaa agatgctttt   2220
tggaatatgt gccatgttct taacttcttt tacgctaatg atgatggctt cactggaaat   2280
acaatattgg atacagttaa agatatcatc tacaacccac ttgttttggt caatgagaac   2340
gaggaacaaa gataa                                                    2355
```

SEQ ID NO: 46
Stevia rebaudiana

```
MNLSLCIASP LLTKSSRPTA LSAIHTASTS HGGQTNPTNL IIDTTKERIQ KLFKNVEISV    60
SSYDTAWVAM VPSPNSPKSP CFPECLNWLI NNQLNDGSWG LVNHTHNHNH PLLKDSLSST   120
LACIVALKRW NVGEDQINKG LSFIESNLAS ATDKSQPSPI GFDIIFPGLL EYAKNLDINL   180
LSKQTDFSLM LHKRELEQKR CHSNEIDGYL AYISEGLGNL YDWNMVKKYQ MKNGSVFNSP   240
SATAAAFINH QNPGCLNYLN SLLDKFGNAV PTVYPLDLYI RLSMVDTIER LGISHHFRVE   300
IKNVLDETYR CWVERDEQIF MDVVTCALAF RLLRIHGYKV SPDQLAEITN ELAFKDEYAA   360
LETYHASQIL YQEDLSSGKQ ILKSADFLKG ILSTDSNRLS KLIHKEVENA LKFPINTGLE   420
RINTRRNIQL YNVDNTRILK TTYHSSNISN TYYLRLAVED FYTCQSIYRE ELKGLERWVV   480
QNKLDQLKFA RQKTAYCYFS VAATLSSPEL SDARISWAKN GILTTVVDDF FDIGGTIDEL   540
TNLIQCVEKW NVDVDKDCCS EHVRILFLAL KDAICWIGDE AFKWQARDVT SHVIQTWLEL   600
MNSMLREAIW TRDAYVPTLN EYMENAYVSF ALGPIVKPAI YFVGPKLSEE IVESSEYHNL   660
FKLMSTQGRL LNDIHSFKRE FKEGKLNAVA LHLSNGESGK VEEEVVEEMM MMIKNKRKEL   720
MKLIFEENGS IVPRACKDAF WNMCHVLNFF YANDDGFTGN TILDTVKDII YNPLVLVNEN   780
EEQR                                                                784
```

SEQ ID NO: 47
Artificial Sequence

```
atggctatgc cagtgaagct aacacctgcg tcattatcct taaaagctgt gtgctgcaga    60
ttctcatccg gtggccatgc tttgagattc gggagtagtc tgccatgttg gagaaggacc   120
cctacccaaa gatctacttc ttcctctact actagaccag ctgccgaagt gtcatcaggt   180
aagagtaaac aacatgatca ggaagctagt gaagcgacta tcagacaaca attacaactt   240
gtggatgtcc tggagaatat gggaatatcc agacattttg ctgcagagat aaagtgcata   300
ctagacagaa cttacagatc ttggttacaa agacacgagg aaatcatgct ggacactatg   360
acatgtgcta tggcttttag aatcctaaga ttgaacggat acaacgtttc atcagatgaa   420
ctataccacg ttgtagaggc atctggtctg cataattctt gggtgggta tcttaacgat   480
accagaacac tacttgaatt acacaaggct tcaacagtta gtatctctga ggatgaatct   540
atcttagatt caattggctc tagatccaga acattgctta gagaacaatt ggagtctggt   600
ggcgcactga gaaagccttc tttattcaaa gaggttgaac atgcactgga tggaccttt    660
tacaccacac ttgatagact tcatcatagg tggaatattg aaaacttcaa cattattgag   720
caacatgt tggagactcc atacttatct aaccagcata catcaaggga tatcctagca   780
ttgtcaatta gagattttc ctcctcacaa ttcacttatc aacaagagct acagcatctg   840
gagagttggg ttaaggaatg tagattagat caactacagt tcgcaagaca gaaattagcg   900
tacttttacc tatcagccgc aggcaccatg ttttctcctg agctttctga tgcgagaaca   960
ttatgggcca aaaacggggt gttgacaact attgttgatg atttctttga tgttgccggt  1020
tctaaagagg aattggaaaa cttagtcatg ctggtcgaaa tgtgggatga acatcacaaa  1080
gttgaattct attctgagca ggtcgaaatc atcttctctt ccatctacga ttctgtcaac  1140
caattgggtg agaaggcctc tttggttcaa gacagatcaa ttacaaaaca ccttgttgaa  1200
atatggttag acttgttaaa gtccatgatg acggaagttg aatggagact gtcaaaatac  1260
gtgcctacag aaaaggaata catgattaat gcctctctta tcttcggcct aggtccaatc  1320
gttttaccag ctttgtattt cgttggtcca aagtttcag aaagtatagt aaaggaccca  1380
gaatatgatg aattgttcaa actaatgtca acatgtggta gattgttgaa tgacgtgcaa  1440
acgttcgaaa gagaatacaa tgagggtaaa ctgaattctg tcagtctatt ggttcttcac  1500
ggaggcccaa tgtctatttc agacgcaaag aggaaattac aaaagcctat tatacgtgt   1560
agaagagatc ttctttcttt ggtccttaga gaagagtctg tagtaccaag accatgtaag  1620
gaactattct ggaaaatgtg taagtgtgc tatttctttt actcaacaac tgatgggttt  1680
tctagtcaag tcgaaagagc aaaagaggta gacgctgtca taaatgagcc actgaagttg  1740
caaggttctc atacactggt atctgatgtt taa                                1773
```

SEQ ID NO: 48
Zea mays

```
MAMPVKLTPA SLSLKAVCCR FSSGGHALRF GSSLPCWRRT PTQRSTSSST TRPAAEVSSG    60
KSKQHDQEAS EATIRQQLQL VDVLENMGIS RHFAAEIKCI LDRTYRSWLQ RHEEIMLDTM   120
TCAMAFRILR LNGYNVSSDE LYHVVEASGL HNSLGGYLND TRTLLELHKA STVSISEDES   180
ILDSIGSRSR TLLREQLESG GALRKPSLFK EVEHALDGPF YTTLDRLHHR WNIENFNIIE   240
QHMLETPYLS NQHTSRDILA LSIRDFSSSQ FTYQQELQHL ESWVKECRLD QLQFARQKLA   300
YFYLSAAGTM FSPELSDART LWAKNGVLTT IVDDFFDVAG SKEELENLVM LVEMWDEHHK   360
VEFYSEQVEI IFSSIYDSVN QLGEKASLVQ DRSITKHLVE IWLDLLKSMM TEVEWRLSKY   420
VPTEKEYMIN ASLIFGLGPI VLPALYFVGP KISESIVKDP EYDELFKLMS TCGRLLNDVQ   480
TFEREYNEGK LNSVSLLVLH GGPMSISDAK RKLQKPIDTC RRDLLSLVLR EESVVPRPCK   540
ELFWKMCKVC YFFYSTTDGF SSQVERAKEV DAVINEPLKL QGSHTLVSDV              590
```

TABLE 19-continued

Sequences disclosed herein.

SEQ ID NO: 49
Artificial Sequence
```
atgcagaact tccatggtac aaaggaaagg atcaaaaaga tgtttgacaa gattgaattg      60
tccgtttctt cttatgatac agcctgggtt gcaatggtcc catcccctga ttgcccagaa     120
acacctgtt ttccagaatg tactaaatgg atcctagaaa atcagttggg tgatggtagt     180
tggtcacttc ctcatggcaa tccacttcta gttaaagatg cattatcttc cactcttgct     240
tgtattctgg ctcttaaaag atggggaatc ggtgaggaac agattaacaa aggactgaga     300
ttcatagaac tcaactctgc tagtgtaacc gataacgaac aacacaaacc aattggattt     360
gacattatct ttccaggtat gattgaatac gctatagact tagacctgaa tctaccacta     420
aaaccaactct acattaactc catgttgcat cgtagagccc ttgaattgac atcaggtgga     480
ggcaaaaatc tagaaggtag aagagcttac ttggcctacg tctctgaagg aatcggtaag     540
ctgcaagatt gggaaatggc tatgaaatac aacgtaaaa acggatctct gttcaatagt     600
ccatcaacaa ctgcagctgc attcatccat atacaagatg ctgaatgcct ccactatatt     660
cgttctcttc tccagaaatt tggaaacgca gtccctacaa tatacccctct cgatatctat     720
gccagacttt caatggtaga tgccctgaaa cgtcttgtta ttgatagaca tttcagaaag     780
gagagaaagt tcgttctgga tgaaacatac agatttggt tgcaaggaga agaggagatt     840
ttctccgata acgcaacctg tgctttggcc ttcagaatat tgagacttaa tggttacgat     900
gtctctcttg aagatcactt ctctaactct ctgggcggtt acttaaagga ctcaggagca     960
gctttagaac tgtacagagc cctccaattg tcttacccag acagtccct cctggaaaag    1020
caaaattcta gaacttctta cttcttaaaa caaggtttat ccaatgtctc cctctgtgtt    1080
gacagattgc gtaaaaacat aattggagag gtgcatgatg ctttaaactt ttccgaccac    1140
gctaacttac aaagattagc tattcgtaga aggattaagc attacgctac tgacgataca    1200
aggattctaa aaacttccta cagatgctca acaatcggta ccaagattt tctaaaactt    1260
gcagtggaag atttcaatat ctgtcaatca atacaaagag aggaattcaa gcatattgaa    1320
agatgggtcg ttgaaagacg tctagacaag ttaaagttcg ctagacaaaa agaggcctat    1380
tgctatttct cagccgcagc aacattgttt gcccctgaat tgtctgatgc tagaatgtct    1440
tgggccaaaa atggtgtatt gacaactgtg gttgatgatt tcttcgatgt cggaggctct    1500
gaagaggaat tagttaactt gatagaattg atcgagcgtt gggatgtgaa tggcagtgca    1560
gatttttgta gtgaggaagt tgagattatc tattctgcta tccactcaac tatctctgaa    1620
ataggtgata agtcatttgg ctggcaaggt agagatgtaa agtctcaagt tatcaagatc    1680
tggctggact tattgaaatc aatgttaact gaagctcaat ggtcttcaaa caagtctgtt    1740
cctaccctag atgagtatat gacaaccgcc catgtttcat tcgcacttgg tccaattgta    1800
cttccagcct tatacttcgt tggcccaaag ttgtcagaag aggttgcagg tcatcctgaa    1860
ctactaaacc tctacaaagt cacatctact tgtggcagac tactgaatga ttggagaagt    1920
tttaagagag aatccgagga aggtaagctc aacgctatta gtttatacat gatccactcc    1980
ggtggtgctt ctacagaaga ggaaacaatc gaacatttca aggtttgat tgattctcag    2040
agaaggcaac tgttacaatt ggtgttgcaa gagaaggata gtatcatacc tagaccatgt    2100
aaagatctat tttggaatat gattaagtta ttacacactt tctacatgaa agatgatggc    2160
ttcacctcaa atgagatgag gaatgtagtt aaggcaatca ttaacgaacc aatctcactg    2220
gatgaattat ga                                                        2232
```

SEQ ID NO: 50
Populus trichocarpa
```
MSCIRPWFCP SSISATLTDP ASKLVTGEFK TTSLNFHGTK ERIKKMFDKI ELSVSSYDTA      60
WVAMVPSPDC PETPCFPECT KWILENQLGD GSWSLPHGNP LLVKDALSST LACILALKRW     120
GIGEEQINKG LRFIELNSAS VTDNEQHKPI GFDIIFPGMI EYAKDLDLNL PLKPTDINSM     180
LHRRALELTS GGGKNLEGRR AYLAYVSEGI GKLQDWEMAM KYQRKNGSLF NSPSTTAAAF     240
IHIQDAECLH YIRSLLQKFG NAVPTIYPLD IYARLSMVDA LERLGIDRHF RKERKFVLDE     300
TYRFWLQGEE EIFSDNATCA LAFRILRLNG YDVSLEDHFS NSLGGYLKDS GAALELYRAL     360
QLSYPDESLL EKQNSRTSYF LKQGLSNVSL CGDRLRKNII GEVHDALNFP DHANLQRLAI     420
RRRIKHYATD DTRILKTSYR CSTIGNQDFL KLAVEDFNIC QSIQREEFKH IERWVVERRL     480
DKLKFARQKE AYCYFSAAAT LFAPELSDAR MSWAKNGVLT TVVDDFFDVG GSEEELVNLI     540
ELIERWDVNG SADFCSEEVE IIYSAIHSTI SEIGDKSFGW QGRDVKSHVI KIWLDLLKSM     600
LTEAQWSSNK SVPTLDEYMT TAHVSFALGP IVLPALYFVG PKLSEEVAGH PELLNLYKVM     660
STCGRLLNDW RSFKRESEEG KLNAISLYMI HSGGASTEEE TIEHFKGLID SQRRQLLQLV     720
LQEKDSIIPR PCKDLFWNMI KLLHTFYMKD DGFTSNEMRN VVKAIINEPI SLDEL         775
```

SEQ ID NO: 51
Artificial Sequence
```
atgtctatca accttcgctc ctccggttgt tcgtctccga tctcagctac tttggaacga      60
ggattggact cagaagtaca gacaagagct aacaatgtga gcttgagca aacaaaggag     120
aagattagga agatgttgga gaaagtggag ctttctgttt cggcctacga tactagttgg     180
gtagcaatgg ttccatcacc gagctcccaa atgctccac ttttcccaca gtgtgtgaaa     240
tggttattgg ataatcaaca tgaagatgga tcttgggac ttgataacca tgaccatcaa     300
tctcttaaga aggatgtgtt atcatctaca ctggctgtta tcctcgcgtt aaagaagtgg     360
ggaattggtg aaagacaaat aaacaagggt ctccagttta ttgagctgaa ttctgcatta     420
gtcactgatg aaaccataca gaaaccaaca gggtttgata ttatatttcc tgggatgatt     480
aaatatgcta gagatttgaa tctgacgatt ccattgggct cagaagtggt ggatgacatg     540
atacgaaaa gagatctgaa tcttaaatgt gatagtgaaa agttttcaaa gggaagagaa     600
gcatatctgg cctatgtttt agaggggaca agaaacctaa agattgggga tttgatagtc     660
aaatatcaaa ggaaaaatgg gtcactgttt gattctccag ccacaacagc agctgctttt    720
actcagtttg gaatgatgg ttgtctccgt tatctctgtt ctctccttca gaaattcgag     780
gctgcagttc cttcagttta tccatttgat caatatgcac gcctagtat aattgtcact     840
cttgaaagct taggaattga tagagatttc aaaaccgaaa tcaaagtcat attggatagtc     900
acctatagat attggcttcg tggggatgaa gaaatatgtt tggacttggc cacttgtgct     960
ttggcttttcc gattattgct tgctcatggc tatgatgtgt cttacgatcc gctaaaacca    1020
tttgcagaag aatctggttt ctctgatact ttggaaggat atgttaagaa tacgtttct    1080
gtgttagaat tatttaaggc tgctcaaagt tatccacatg aatcagcttt gagaagcag    1140
```

TABLE 19-continued

Sequences disclosed herein.

```
tgttgttgga ctaaacaata tctggagatg gaattgtcca gctgggttaa gacctctgtt   1200
cgagataaat acctcaagaa agaggtcgag gatgctcttg cttttccctc ctatgcaagc   1260
ctagaaagat cagatcacag gagaaaaata ctcaatggtt ctgctgtgga aaacaccaga   1320
gttacaaaaa cctcatatcg tttgcacaat atttgcacct ctgatatcct gaagttagct   1380
gtggatgact tcaatttctg ccagtccata caccgtgaag aaatggaacg tcttgatagg   1440
tggattgtgg agaatagatt gcaggaactg aaatttgcca gacagaagct ggcttactgt   1500
tatttctctg gggctgcaac tttattttct ccagaactat ctgatgctcg tatatcgtgg   1560
gccaaaggtg gagtacttac aacgttgta gacgacttcc ttgatgttgg agggtccaaa   1620
gaagaactga aaaacctcat acacttggtc gaaaagtggg atttgaacgg tgttcctgag   1680
tacagctcag aacatgttga gatcatattc tcagttctaa gggacaccat tctcgaaaca   1740
ggagacaaag cattcaccta tcaaggacgc aatgtgacac accacattgt gaaaatttgg   1800
ttggatctgc tcaagtctat gttgagagaa gccgagtggt ccagtgacaa gtcaaccaca   1860
agcttggagg attacatgga aaatgcgtac atatcatttg cattaggacc aattgtcctc   1920
ccagctacct atctgatcgg acctccactt ccagagaaga cagtcgatag ccaccaatat   1980
aatcagctct acaagctcgt gagcactatg ggtcgtcttc taaatgacat acaaggtttt   2040
aagagagaaa gcgcggaagg gaagctgaat gcggtttcat tgcacatgaa acacgagaga   2100
gacaatcgca gcaaagaagt gatcatagaa tcgatgaaag gttagcaga gagaaagagg   2160
gaagaattgc ataagctagt tttggaggag aaaggaagtg tggttccaag ggaatgcaaa   2220
gaagcgttct tgaaaatgag caaagtgttg aacttatttt acaggaagga cgatggattc   2280
acatcaaatg atctgatgag tcttgttaaa tcagtgatct acgagcctgt tagcttacag   2340
aaagaatctt taacttga                                                 2358
```

SEQ ID NO: 52
Arabidopsis thaliana

```
MSINLRSSGC SSPISATLER GLDSEVQTRA NNVSFEQTKE KIRKMLEKVE LSVSAYDTSW    60
VAMVPSPSSQ NAPLFPQCVK WLLDNQHEDG SWGLDNHDHQ SLKKDVLSST LASILALKKW   120
GIGERQINKG LQFIELNSAL VTDETIQKPT GFDIIFPGMI KYARDLNLTI PLGSEVVDDM   180
IRKRDLDLKC DSEKFSKGRE AYLAYVLEGT RNLKDWDLIV KYQRKNGSLF DSPATTAAAF   240
TQFGNDGCLR YLCSLLQKFE AAVPSVYPFD QYARLSIIVT LESLGIDRDF KTEIKSILDE   300
TYRYWLRGDE EICLDLATCA LAFRLLLAHG YDVSYDPLKP FAEESGFSDT LEGYVKNTFS   360
VLELFKAAQS YPHESALKKQ CCWTKQYLEM ELSSWVKTSV RDKYLKKEVE DALAFPSYAS   420
LERSDHRRKI LNGSAVENTR VTKTSYRLHN ICTSDILKLA VDDFNFCQSI HREEMERLDR   480
WIVENRLQEL KFARQKLAYC YFSGAATLFS PELSDARISW AKGGVLTTVV DDFFDVGGSK   540
EELENLIHLV EKWDLNGVPE YSSEHVEIIF SVLRDTILET GDKAFTYQGR NVTHHIVKIW   600
LDLLKSMLRE AEWSSDKSTP SLEDYMENAY ISFALGPIVL PATYLIGPPL PEKTVDSHQY   660
NQLYKLVSTM GRLLNDIQGF KRESAEGKLN AVSLHMKHER DNRSKEVIIE SMKGLAERKR   720
EELHKLVLEE KGSVVPRECK EAFLKMSKVL NLFYRKDDGF TSNDLMSLVK SVIYEPVSLQ   780
KESLT                                                               785
```

SEQ ID NO: 53
Artificial Sequence

```
atggaatttg atgaaccatt ggttgacgaa gcaagatctt tagtgcagcg tactttacaa    60
gattatgatg acagatacgg cttcggtact atgtcatgtg ctgcttatga tacagcctgg   120
gtgtctttag ttacaaaaac agtcgatggg agaaaacaat ggcttttccc agagtgtttt   180
gaatttctac tagaaacaca atctgatgcc ggaggatggg aaatcgggaa ttcagcacca   240
atcgacggta tattgaatac agctgcatcc ttacttgctc taaaacgtca cgttcaaact   300
gagcaaatca tccaacctca acatgaccat aaggatctag caggtagagc tgaacgtgcc   360
gctgcatctt tgagagcaca atggctgca ttggatgtgt ctacaactga acacgtcggt   420
tttgagataa ttgttcctgc aatgctagac ccattagaag ccgaagatcc atctctagtt   480
ttcgattttc cagctaggaa accttttgatg aagattcatg atgctaagat gagtagattc   540
aggccagaat acttgtatgg caaacaacca atgaccgcct acattcatt agaggctttc   600
ataggcaaaa tcgacttcga taaggtaaga caccaccgta cccatgggtc tatgatgggt   660
tctccttcat ctaccgcagc ctacttaatg cacgcttcac aatgggatgg tgactcagag   720
gcttaccctta gacacgtgat taaacacgca gcagggcagg gaactggtgc tgtaccatct   780
gctttcccat caacacattt tgagtcatct tggattctta ccacattgtt tagagctgga   840
ttttcagctt ctcatcttgc ctgtgatgag ttgaacaagt tggtcgagat acttgagggc   900
tcattcgaga aggaaggtgg ggcaatcggt tacgctccag tgtttcaagc agatgttgat   960
gatactgcta aaacaataag tacattagca gtccttggaa gagatgctac accaagacaa  1020
atgatcaagg tatttgaagc taatacacat tttagaacat ccctggtga aagagatcct  1080
tctttgacag ctaattgtaa tgctctatca gcctactacc accaaccaga tgcagcaatg  1140
tatggatctc aaattcaaaa gattaccaaa tttgtctgta actattggtg gaagtctgat  1200
ggtaagatta aagataagtg gaacacttgc tacttgtacc catctgtctt attagttgag  1260
gttttggttg atcttgttag tttattggag cagggtaaat tgcctgatgt tttggatcaa  1320
gagcttcaat acagagtcgc catcacattg ttccaagcat gtttaaggcc attactagac  1380
caagatgccg aaggatcatg gaacaagtct atcgaagcca cagcctacgg catccttatc  1440
ctaactgaag ctaggagagt ttgtttcttc gacagattgt ctgagccatt gaatgaggca  1500
atccgtagag gtatcgcttt cgccgactct atgtctggaa ctgaagctca gttgaactac  1560
atttggatcg aaaaggttag ttacgcacct gcattattga ctaaatccta tttgttagca  1620
gcaagatgcg ctgctaagtc tccttttaggc gcttccgtag gtcttctttt gtggactcca  1680
ccaagagaag gattggataa gcatgtcaga ttattccatc aagctgagtt attcagatcc  1740
cttccagaat gggaattaag agcctccatg attgaagcag ctttgttcac accacttcta  1800
agagcacata gactagacgt tttccctaga caagatgtag tgaagacaa atatcttgat  1860
gtagttccat tcttttggac tgccgctaac aacagagata agaacttacg ttccactcta  1920
ttccttacg atatgtgttt tatcgcaatg ttaaacttcc agttagacga attcatggaa  1980
gccacagccg gtatcttatt cagatgatcat atggatgatt tgaggcaatt gattcatgat  2040
cttttggcag agaaaacttc cccaaagagt ctggtagaa gtagtcaggg cacaaaagat  2100
gctgactcag gtatagagga agacgtgtca atgtccgatt cagcttcaga ttcccaggat  2160
agaagtccag aatacgactt ggttttcagt gcattgagta ccctttacaa acatgtcttg  2220
```

TABLE 19-continued

Sequences disclosed herein.

```
caacacccat ctatacaaag tgcctctgta tgggatagaa aactacttgc tagagagatg   2280
aaggcttact tacttgctca tatccaacaa gcagaagatt caactccatt gtctgaattg   2340
aaagatgtgc ctcaaaagac tgatgtaaca agagtttcta catctactac taccttcttt   2400
aactgggtta gaacaacttc cgcagaccat atatcctgcc catactcctt ccactttgta   2460
gcatgccatc taggcgcagc attgtcacct aaagggtcta acggtgattg ctatccttca   2520
gctggtgaga agttcttggc agctgcagtc tgcagacatt tggccaccat gtgtagaatg   2580
tacaacgatc ttggatcagc tgaacgtgat tctgatgaag gtaatttgaa ctccttggac   2640
ttccctgaat tcgccgattc cgcaggaaac ggagggatag aaattcagaa ggccgctcta   2700
ttaaggttag ctgagtttga gagagattca tacttagagg ccttccgtcg tttacaagat   2760
gaatccaata gagttcacgg tccagccggt ggtgatgaag ccagattgtc cagaaggaga   2820
atggcaatcc ttgaattctt cgcccagcag gtagatttgt acggtcaagt atacgtcatt   2880
agggatattt ccgctcgtat tcctaaaaac gaggttgaga aaagagaaa attggatgat   2940
gctttcaatt ga                                                       2952

SEQ ID NO: 54
Phomopsis amygdali
MEFDEPLVDE ARSLVQRTLQ DYDDRYGFGT MSCAAYDTAW VSLVTKTVDG RKQWLFPECF     60
EFLLETQSDA GGWEIGNSAP IDGILNTAAS LLALKRHVQT EQIIQPQHDH KDLAGRAERA   120
AASLRAQLAA LDVSTTEHVG FEIIVPAMLD PLEAEDPSLV FDFPARKPLM KIHDAKMSRF   180
RPEYLYGKQP MTALHSLEAF IGKIDFDKVR HHRTHGSMMG SPSSTAAYLM HASQWDGDSE   240
AYLRHVIKHA AGQGTGAVPS AFPSTHFESS WILTTLFRAG FSASHLACDE LNKLVEILEG   300
SFEKEGGAIG YAPGFQADVD DTAKTISTLA VLGRDATPRQ MIKVFEANTH FRTYPGERDP   360
SLTANCNALS ALLHQPDAAM YGSQIQKITK FVCDYWWKSD GKIKDKWNTC YLYPSVLLVE   420
VLVDLVSLLE QGKLPDVLDQ ELQYRVAITL FQACLRPLLD QDAEGSWNKS IEATAYGILI   480
LTEARRVCFF DRLSEPLNEA IRRGIAFADS MSGTEAQLNY IWIEKVSYAP ALLTKSYLLA   540
ARWAAKSPLG ASVGSSLWTP PREGLDKHVR LFHQAELFRS LPEWELRASM IEAALFTPLL   600
RAHRLDVFPR QDVGEDKYLD VVPFFWTAAN NRDRTYASTL FLYDMCFIAM LNFQLDEFME   660
ATAGILFRDH MDDLRQLIHD LLAEKTSPKS SGRSSQGTKD ADSGIEEDVS MSDSASDSQD   720
RSPEYDLVFS ALSTFTKHVL QHPSIQSASV WDRKLLAREM KAYLLAHIQQ AEDSTPLSEL   780
KDVPQKTDVT RVSTSTTTFF NWVRTTSADH ISCPYSFHFV ACHLGAALSP KGSNGDCYPS   840
AGEKFLAAAV CRHLATMCRM YNDLGSAERD SDEGNLNSLD FPEFADSAGN GGIEIQKAAL   900
LRLAEFERDS YLEAFRRLQD ESNRVHGPAG GDEARLSRRR MAILEFFAQQ VDLYGQVYVI   960
RDISARIPKN EVEKKRKLDD AFN                                          983

SEQ ID NO: 55
Artificial Sequence
atggcttcta gtacacttat ccaaaacaga tcatgtggcg tcacatcatc tatgtcaagt    60
tttcaaatct tcagaggtca accactaaga tttcctggca ctagaacccc agctgcagtt   120
caatgcttga aaaagaggag atgccttagg ccaaccgaat ccgtactaga atcatctcct   180
ggctcgtt catatagaat agtaactggc ccttctgaaa ttaaccctaa ttctaacggg   240
cacttgcaag agggttcctt gactcacagg ttaccaatac caatggaaaa atctatcgat   300
aacttccaat ctactctata tgtgtcagat atttggtctg aaacactaca gagaactgaa   360
tgtttgctac aagtaactga aaacgtccag atgaatgagt ggattgagga aattagaatg   420
tacttagaa atatgacttt aggtgaaatt tccatgtccc cttacgacac tgcttgggtg   480
gctagagttc cagcgttgga cggttctcat gggcctcaat tccacagatc tttgcaatgg   540
attatcgaca accaattacc agatgggac tggggcgaac cttctctttt cttgggttac   600
gatagagttt gtaatacttt agcctgtgtg attgcgttga aaacatgggg tgttggggca   660
caaacgttg aaagaggaat tcagttccta caatctaaca tatacaagat ggaggaagat   720
gacgctaatc atatgccaat aggattcgaa atcgtattcc ctgctatgat ggaagatgcc   780
aaagcattag gtttggattt gccatacgat gctactattt tgcaacagat ttcagccgaa   840
agagagaaaa agatgaaaaa gatcccaatg gcaatggtgt acaaatacc aaccacttta   900
cttcactcct tagaaggctt gcatagagaa gttgattgga ataagttgtt acaattacaa   960
tctgaaaatg gtagttttct ttattcacct gcttcaaccg catgcgcctt aatgtacact  1020
aaggacgtta aatgttttga ttacttaaac cagttgttga tcaagttcga ccacgcatgc  1080
ccaaatgtat atccagtcga tctattcgaa agattatgga tggttgacag attgcagaga  1140
ttagggatct ccagatactt tgaaagagag attagagatt gtttacaata cgtctacaga  1200
tattgggaag attgtggaat cggatgggct tctaactctc ccgtacaaga tgttgatgat  1260
acagccatgg cgtttagact tttaaggact catggtttcg acgtaaagga agattgcttt  1320
agacagtttt tcaaggacgg agaattcttc tgcttcgcag gccaatcatc tcaagcagtt  1380
acaggcatgt ttaatctttc aagagccagt caaacattgg ttccaggaga atctttattg  1440
aaaaaggcta gaaccttctc tagaaacttc ttgagaacaa agcatgaaa caacgaatgt  1500
ttcgataaat ggatcattac taaagatttg gctggtgaag tcgagtataa cttgaccttc  1560
ccatggtatg cctctttgcc tagattaaaa cataggacat acttagatca atatggaatc  1620
gatgatatct ggataggcaa atctttatac aaaatgcctg ctgttaccaa cgaagttttc  1680
ctaaagttgg caaaggcaga cttaacatg tgtcaagctc tacacaaaaa ggaattgaa  1740
caagtgataa agtggaacgc gtcctgtcaa ttcagagatc ttgaattcgc cagacaaaaa  1800
tcagtagaat gctattttgc tggtcagcc acaatgttcg aaccagaaat ggttcaagct  1860
agattagtct gggcaagatg ttgtgtattg acaactgtct tagacgatta ctttgaccac  1920
gggacacctg ttgaggaact tagagtgttt gttcaagctg tcagaacgtg aatccagaa  1980
ttgatcaacg gtttgccaga gcaagctaaa atcttgttta tgggcttata caaaacagtt  2040
aacacaattg cagaggaagc attcatggca cagaaaagag acgtccatca tcatttgaaa  2100
cactattggg acaagttgat aacaagtgcc ctaaggagg ccgaatggc agagtcaggt  2160
tacgtcccaa catttgtta atacatggaa gtagctgaaa tttcgttgc tctagaacca  2220
attgtctgta gtaccttgtt ctttgcgggt catagactag atgaggatgt tctagatagt  2280
tacgattacc atctagttat gcattggta aacagtcg gtagaatctt gaatgatata  2340
caaggcatga gagggaggc ttcacaaggt aagatctcat cagttcaaat ctacatggag  2400
gaacatccat ctgttccatc tgaggccatg gcgatcgctc atcttcaaga gttagttgat  2460
aattcaatgc agcaattgac atacgaagtt cttaggttca ctgcgcttcc aaaaagttgt  2520
```

TABLE 19-continued

Sequences disclosed herein.

```
aagagaatcc acttgaatat ggctaaaatc atgcatgcct tctacaagga tactgatgga   2580
ttctcatccc ttactgcaat gacaggattc gtcaaaaagg ttcttttcga acctgtgcct   2640
gagtaa                                                              2646

SEQ ID NO: 56
Physcomitrella patens
MASSTLIQNR SCGVTSSMSS FQIFRGQPLR FPGTRTPAAV QCLKKRRCLR PTESVLESSP     60
GSGSYRIVTG PSGINPSSNG HLQEGSLTHR LPIPMEKSID NFQSTLYVSD IWSETLQRTE    120
CLLQVTENVQ MNEWIEEIRM YFRNMTLGEI SMSPYDTAWV ARVPALDGSH GPQFHRSLQW    180
IIDNQLPDGD WGEPSLFLGY DRVCNTLACV IALKTWGVGA QNVERGIQFL QSNIYKMEED    240
DANHMPIGFE IVFPAMMEDA KALGLDLPYD ATILQQISAE REKKMKKIPM AMVKYPTTL     300
LHSLEGLHRE VDWNKLLQLQ SENGSFLYSP ASTACALMYT KDVKCFDYLN QLLIKFDHAC    360
PNVYPVDLFE RLWMVDRLQR LGISRYFERE IRDCLQYVYR YWKDCGIGWA SNSSVQDVDD    420
TAMAFRLLRT HGFDVKEDCF RQFFKDGEFF CFAGQSSQAV TGMFNLSRAS QTLFPGESLL    480
KKARTFSRNF LRTKHENNEC FDKWIITKDL AGEVEYNLTF PWYASLPRLE HRTYLDQYGI    540
DDIWIGKSLY KMPAVTNEVF LKLAKADFNM CQALHKKELE QVIKWNASCQ FRDLEFARQK    600
SVECYFAGAA TMFEPEMVQA RLVWARCCVL TTVLDDYFDH GTPVEELRVF VQAVRTWNPE    660
LINGLPEQAK ILFMGLYKTV NTIAEEAFMA QKRDVHHHLK HYWDKLITSA LKEAEWAESG    720
YVPTFDEYME VAEISVALEP IVCSTLFFAG HRLDEDVLDS YDYHLVMHLV NRVGRILNDI    780
QGMKREASQG KISSVQIYME EHPSVPSEAM AIAHLQELVD NSMQQLTYEV LRFTAVPKSC    840
KRIHLNMAKI MHAFYKDTDG FSSLTAMTGF VKKVLFEPVP E                       881

SEQ ID NO: 57
Artificial Sequence
atgcctggta aaattgaaaa tggtacccca aaggacctca agactggaaa tgattttgtt     60
tctgctgcta agagtttact agatcgagct ttcaaaagtc atcattccta ctacggatta    120
tgctcaactt catgtcaagt ttatgataca gcttgggttg caatgattcc aaaaacaaga    180
gataatgtaa aacagtggtt gtttccagaa tgtttccatt acctcttaaa aacacaagcc    240
gcagatggct catggggttc attgcctaca acacagacag cgggtatcct agatacagcc    300
tcagctgtgc tggcattatt gtgccacgca caagagcctt acaaatatt ggatgtatct     360
ccagatgaaa tgggggttgag aatagaacac ggtgtcacat ccttgaaacg tcaattagca    420
gtttggaatg atgtggagga caccaaccat attggcgtcg agtttatcat accagcctta    480
cttttccatg ctagaaaagga attagatgtt ccatctttg aattttccatg taggtccatc    540
ttagagaaa tgcacgggga gaaattaggc atttcgacc tggaacaagt ttacggcaag      600
ccaagctcat tgttgcactc attggaagca tttctcggta agctagattt tgatcgacta    660
tcacatcacc tataccacgg cagtatgatg gcatctccat cttcaacggc tgcttatctt    720
attgggcta caaaatggga tgacgaagcc gaagattacc taagacatgt aatgcgtaat     780
ggtgcaggac atgggaatgg aggtattct ggtacatttc caactactca tttcgaatgt     840
agctggatta tagcaacgtt gttaaaggtt ggctttactt tgaagcaaat tgacggcgat    900
ggcttaagag gtttatcaac catcttactt gaggcgcttc gtgatgagaa tggtgtcata    960
ggctttgccc ctagaacagc agatgtgtagt gacacagcca aagctctat ggccttgtca    1020
ttggtaaaacc agccagtgtc acctgatatc atgattaagg tctttgaggg caaagaccat   1080
tttaccactt ttggttcaga aagagatcca tcattgactt ccaacctgca cgtccttta    1140
tctttactta aacaatctaa cttgtctcaa taccatccca aaatcctcaa acaacatta    1200
ttcacttgta gatggtggtg ggggttccgat cattgtgtca aagacaaatg gaatttgagt   1260
cacctatatc caactatgtt gttggttgaa gccttcactg aagtgctcca tctcattgac    1320
ggtggtgaat tgtctagtct gtttgatgaa tcctttaagt gtaagattgg tcttagcatc    1380
tttcaagcgg tacttagaat aatcctcacc caagacaacg acggctcttg gagaggatac    1440
agagaacaga cgtgttacgc aatattggct ttagttcaag cgagacatgt atgcttttc     1500
actcacatgt tgacagact gcaatcatgt gttgatcgag gtttctcatg gttgaaatct    1560
tgctctttc attctcaaga cctgacttgg acctctaaaa cagcttatga agtgggtttc    1620
gtagctgaag catataaact agctgcttta caatctgctt ccctgaggt tcctgctgcc   1680
accattggac attctgtcac gtctgccgtt ccatcaagtg atcttgaaaa atacatgaga   1740
ttggtgagaa aaactgcgtt attctctcca ctgatgagt ggggtctaat ggcttctatc    1800
atcgaatctt cattttcgt accattactg caggcacaaa gagttgaaat atcccctaga    1860
gataatatca aggtggacga agataagtac ttgtctatta tcccattcac atgggtcgga   1920
tgcaataata ggtctagaac tttcaagt aacagatgc tatacgatat gatgtacctt     1980
tcattactcg gctatcaaac cgacgagtac atggaagctg tagctgggcc agtgtttggg    2040
gatgtttcct tgttacatca aacaattgat aaggtgattg ataatacaat gggtaacctt    2100
gcgagagcca atgaacagt acacagtggt aatggacatc agcacgaatc tcctaatata   2160
ggtcaagtcg aggacacctt gactcgtttc acaaattcaa tcttgaatca caaagacgtc   2220
cttaactcta gctcatctga tcaagatact ttgagaagag agtttagaac attcatgcac   2280
gctcatataa cacaaatcga agataactca cgattcagta agcaagcctc atccgatgcg   2340
ttttcctctc ctgaacaatc ttactttcaa tgggtgaact caactggtgg ctcacatgtc    2400
gcttcgcgcct attcatttgc cttctctaat tgcctcatgt ctgcaaattt gttgcagggt    2460
aaagacgcat ttccaagcgg aacgcaaaag tactaatcc cctctgttat gagacatgcc    2520
acaaacatgt gtagaatgta taacgacttt ggctctattg ccagagacaa cgctgagaga    2580
aatgttaata gtattcattt tcctgagttt actctctgta acggaacttc tcaaaaccta    2640
gatgaaagga aggaaagact tctgaaaatc gcaacttacg aacaagggta tttggataga    2700
gcactagagg ccttggaaag acagagtaga gatgatgccg gagacagagc tggatctaaa    2760
gatatgagaa agttgaaaat cgttaagtta ttctgtgatg ttacggactt atacgatcag    2820
ctctacgtta tcaaagattt gtcatcctct atgaagtaa                          2859

SEQ ID NO: 58
Gibberella fujikuroi
MPGKIENGTP KDLKTGNDFV SAAKSLLDRA FKSHHSYYGL CSTSCQVYDT AWVAMIPKTR     60
DNVKQWLFPE CFHYLLKTQA ADGSWGSLPT TQTAGILDTA SAVLALLCHA QEPLQILDVS    120
PDEMGLRIEH GVTSLKRQLA VWNDVEDTNH IGVEFIIPAL LSMLEKELDV PSFEFPCRSI    180
```

TABLE 19-continued

Sequences disclosed herein.

```
LERMHGEKLG HFDLEQVYGK PSSLLHSLEA FLGKLDFDRL SHHLYHGSMM ASPSSTAAYL    240
IGATKWDDEA EDYLRHVMRN GAGHGNGGIS GTFPTTHFEC SWIIATLLKV GFTLKQIDGD    300
GLRGLSTILL EALRDENGVI GFAPRTADVD DTAKALLALS LVNQPVSPDI MIKVFEGKDH    360
FTTFGSERDP SLTSNLHVLL SLLKQSNLSQ YHPQILKTTL FTCRWWWGSD HCVKDKWNLS    420
HLYPTMLLVE AFTEVLHLID GGELSSLFDE SFKCKIGLSI FQAVLRIILT QDNDGSWRGY    480
REQTCYAILA LVQARHVCFF THMVDRLQSC VDRGFSWLKS CSFHSQDLTW TSKTAYEVGF    540
VAEAYKLAAL QSASLEVPAA TIGHSVTSAV PSSDLEKYMR LVRKTALFSP LDEWGLMASI    600
IESSFFVPLL QAQRVEIYPR DNIKVDEDKY LSIIPFTWVG CNNRSRTFAS NRWLYDMMYL    660
SLLGYQTDEY MEAVAGPVFG DVSLLHQTID KVIDNTMGNL ARANGTVHSG NGHQHESPNI    720
GQVEDTLTRF TNSVLNHKDV LNSSSSDQDT LRREFRTFMH AHITQIEDNS RFSKQASSDA    780
FSSPEQSYFQ WVNSTGGSHV ACAYSFAFSN CLMSANLLQG KDAFPSGTQK YLISSVMRHA    840
TNMCRMYNDF GSIARDNAER NVNSIHFPEF TLCNGTSQNL DERKERLLKI ATYEQGYLDR    900
ALEALERQSR DDAGDRAGSK DMRKLKIVKL FCDVTDLYDQ LYVIKDLSSS MK           952

SEQ ID NO: 59
Artificial Sequence
atggatgctg tgacgggttt gttaactgtc ccagcaaccg ctataactat tggtggaact     60
gctgtagcat tggcggtagc gctaatcttt tggtacctga atcctacac atcagctaga    120
agatcccaat caaatcatct tccaagagtg cctgaagtcc caggtgttcc attgttagga    180
aatctgttac aattgaagga gaaaaagcca tacatgactt ttacgagatg ggcagcgaca    240
tatggaccta tctatagtat caaaactggg gctacaagta tggttgtggt atcatctaat    300
gagatagcca aggaggcatt ggtgaccaga ttccaatcca tatctacaag gaacttatct    360
aaagccctga aagtacttac agcagataag acaatggtg acgtcaga ttatgatgat    420
tatcataaaa cagttaagag acacatactg accgccgtct tgggtcctaa tgcacagaaa    480
aagcatagaa ttcacagaga tatcatgatg gataacatat ctactcaact tcatgaattc    540
gtgaaaaaca cccagaaca ggaagaggta gaccttagaa aaatctttca atctgagtta    600
ttcggcttag ctatgagaca agccttagga aaggatgtta aaagtttgta cgttgaagac    660
ctgaaaatca ctatgaatag agacgaaatc tttcaagtcc ttgttgttga tccaatgatg    720
ggagcaatcg atgttgattg gagagacttc tttccatacc taaagtgggt cccaaacaaa    780
aagttcgaaa atactattca acaaatgtac atcagaagag aagctgttat gaaatcttta    840
atcaaagagc acaaaaagag aatagcgtca ggcgaaaagc taaatagtta tatcgattac    900
cttttatctg aagctcaaac tttaaccgat cagcaactat tgatgtcctt gtgggaacca    960
atcattgaat cttcagatac aacaatggtc acaacagaat gggcaatgta cgaattagct   1020
aaaaaccccta aattgcaaga taggttgtac agagacatta gtccgtctg tggatctgaa   1080
aagataaccg aagagcatct atcacagctg ccttacatta cagctatttt ccacgaaaca   1140
ctgagaagac actcaccagt tcctatcatt cctctaagac atgtacatga agataccgtt   1200
ctaggcggct accatgttcc tgctggcaca gaacttgccg ttaacatcta cggttgcaac   1260
atggacaaaa acgtttggga aaatccagag aatggaacc cagaaagatt catgaaagag   1320
aatgagacaa ttgattttca aaagacgatg gccttcggtg gtggtaagag agtttgtgct   1380
ggttccttgc aagccctttt aactgcatct attgggattg ggagaatggt tcaagagttc   1440
gaatggaaac tgaaggatat gactcaagag gaagtgaaca cgataggcct aactacacaa   1500
atgttaagac cattgagagc tattatcaaa cctaggatct aa                      1542

SEQ ID NO: 60
Stevia rebaudiana
MDAVTGLLTV PATAITIGGT AVALAVALIF WYLKSYTSAR RSQSNHLPRV PEVPGVPLLG     60
NLLQLKEKKP YMTFTRWAAT YGPIYSIKTG ATSMVVVSSN EIAKEALVTR FQSISTRNLS    120
KALKVLTADK TMVAMSDYDD YHKTVKRHIL TAVLGPNAQK KHRIHRDIMM DNISTQLHEF    180
VKNNPEQEEV DLRKIFQSEL FGLAMRQALG KDVESLYVED LKITMNRDEI FQVLVVDPMM    240
GAIDVDWRDF FPYLKWVPNK KFENTIQQMY IRREAVMKSL IKEHKKRIAS GEKLNSYIDY    300
LLSEAQTLTD QQLLMSLWEP IIESSDTTMV TTEWAMYELA KNPKLQDRLY RDIKSVCGSE    360
KITEEHLSQL PYITAIFHET LRRHSPVPII PLRHVHEDTV LGGYHVPAGT ELAVNIYGCN    420
MDKNVWENPE EWNPERFMKE NETIDFQKTM AFGGGKRVCA GSLQALLTAS IGIGRMVQEF    480
EWKLKDMTQE EVNTIGLTTQ MLRPLRAIIK PRI                                 513

SEQ ID NO: 61
Artificial Sequence
aagcttacta gtaaaatgga cggtgtcatc gatatgcaaa ccattccatt gagaaccgct     60
attgctattg gtggtactgc tgttgctttg gttgttgcat tatactttg gttcttgaga    120
tcctacgctt ccccatctca tcattctaat catttgccac cagtacctga agttccaggt    180
gttccagttt tgggtaattt gttgcaattg aaagaaaaa agccttacat gaccttcacc    240
aagtgggctg aaatgtatgg tccaatctac tctattgaa ctggtgctac ttccatggtt    300
gttgtctctt ctaacgaaat cgccaaagaa gttgttgtta ccagattccc atctatctct    360
accagaaaat tgtcttacgc cttgaaggtt ttgaccgaag ataagtctat ggttgccatg    420
tctgattatc acgattacca taagaccgtc aagagacata tttgactgc tgttttgggt    480
ccaaacgccc aaaaaaagtt tagagcacat agagacacca tgatggaaaa cgtttccaat    540
gaattgcatg ccttcttcga aagaaccca atcaagaag tcaacttgag aaagatcttc    600
caatcccaat tattcggttt ggctatgaag caagccttgg gtaaagatgt tgaatccatc    660
tacgttaagg atttggaaac caccatgaag agagaagaa tcttcgaagt tttggttgtc    720
gatccaatga tgggtgctat tgaagttgat tggagagact tttttcccata cttgaaatgg    780
gttccaaaca agtccttcga aaacatcatc catagaatgt acactagaag agaagctgtt    840
atgaaggcct tgatccaaga acacaagaaa agaattgcct ccggtgaaaa cttgaactcc    900
tacattgatt acttgttgtc tgaagcccaa accttgactg ataagcaatt attgatgtct    960
ttgtgggaac ctattatcga atcttctgat accactatgg ttactactga atgggctatg   1020
tacgaattgg ctaagaatcc aaacatgcaa gacagattat acgaagaaat ccaatccgtt   1080
tgcggttccg aaaagattac tgaagaaaac ttgtcccaat gccatactt gtacgctgtt   1140
ttccaagaaa ctttgagaaa gcactgtcca gttcctatta tgccattgag atatgttcac   1200
gaaaacaccg ttttgggtgg ttatcatgtt ccagctggta ctgaagttgc tattaacatc   1260
```

TABLE 19-continued

Sequences disclosed herein.

```
tacggttgca acatggataa gaaggtctgg gaaaatccag aagaatggaa tccagaaaga  1320
ttcttgtccg aaaaagaatc catggacttg tacaaaacta tggcttttgg tggtggtaaa  1380
agagtttgcg ctggttcttt acaagccatg gttatttctt gcattggtat cggtagattg  1440
gtccaagatt ttgaatgaa gttgaaggat gatgccgaag aagatgttaa cactttgggt  1500
ttgactaccc aaaagttgca tccattattg gccttgatta acccaagaaa gtaactcgag  1560
ccgcgg                                                              1566

SEQ ID NO: 62
Lactuca sativa
MDGVIDMQTI PLRTAIAIGG TAVALVVALY FWFLRSYASP SHHSNHLPPV PEVPGVPVLG    60
NLLQLKEKKP YMTFTKWAEM YGPIYSIRTG ATSMVVVSSN EIAKEVVVTR FPSISTRKLS   120
YALKVLTEDK SMVAMSDYHD YHKTVKRHIL TAVLGPNAQK KFRAHRDTMM ENVSNELHAF   180
FEKNPNQEVN LRKIFQSQLF GLAMKQALGK DVESIYVKDL ETTMKREEIF EVLVVDPMMG   240
AIEVDWRDFF PYLKWVPNKS FENIIHRMYT RREAVMKALI QEHKKRIASG ENLNSYIDYL   300
LSEAQTLTDK QLLMSLWEPI IESSDTTMVT TEWAMYELAK NPNMQDRLYE EIQSVCGSEK   360
ITEENLSQLP YLYAVFQETL RKHCPVPIMP LRYVHENTVL GGYHVPAGTE VAINIYGCNM   420
DKKVWENPEE WNPERFLSEK ESMDLYKTMA FGGGKRVCAG SLQAMVISCI GIGRLVQDFE   480
WKLKDDAEED VNTLGLTTQK LHPLLALINP RK                                 512

SEQ ID NO: 63
Rubus suavissimus
atggccaccc tccttgagca tttccaagct atgccctttg ccatccctat tgcactggct   60
gctctgtctt ggctgttcct cttttacatc aaagtttcat tctttccaa caagagtgct  120
caggctaagc tccctcctgt gccagtggtt cctgggctgc cggtgattgg gaatttactg  180
caactcaagg agaagaaacc ctaccagact tttacaaggt gggctgagga gtatggacca  240
atctattcta tcaggactgg tgcttccacc atggtcgttc tcaataccac ccaagttgca  300
aaagaggcca tggtgaccag atatttatcc atctcaacca gaaagctatc aaacgcacta  360
aagattctta ctgctgataa atgtatggtt gcaataagtg actacaacga ttttcacaag  420
atgataaagc gatacatact ctcaaatgtt cttggaccta gtgctcagaa gcgtcaccgg  480
agcaacagag ataccttgag agctaatgtc tgcagccgat tgcattctca agtaaagaac  540
tctcctcgag aagctgtgaa tttcagaaga gttttttgagt gggaactctt tggaattgca  600
ttgaagcaag cctttgaaa ggacatagaa aagcccattt atgtggagga acttggcact  660
acactgtcaa gagatgagat ctttaaggtt ctagtgcttg acataatgga gggtgcaatt  720
gaggttgatt ggagagattt cttcccttac ctgagatgga ttccgaatac gcgcatggaa  780
acaaaaattc agcgactcta tttccgcagg aaagcagtga tgactgccct gatcaacgag  840
cagaagaagc gaattgcttc aggagaggaa atcaactgct tccatgaaac gctaaggaag  900
gaagggaaga cactgacaat ggaccaaata gtatgttgc tttgggagac ggttattgaa  960
acagcagata ctacaatggt aacgacagaa tgggctatgt atgaagttgc taagagctca 1020
aagcgtcagg atcgtctcta tcaggaaatc caaaaggttt gtggatcgga gatggttaca 1080
gaggaaatact tgtcccaact gccgtacctg aatgcagttt tccatgaaac gctaaggaag 1140
cacagtccgg ctgcgttagt tcctttaaga tatgcacatg aagatacccca actaggaggt 1200
tactacattc cagctggaac tgagattgct ataaacatat acgggtgtaa catggacaag 1260
catcaatggg aaagccctga ggaatggaaa ccggagagat ttttggaccc gaaatttgat 1320
cctatggatt tgtacaagac catggctttt ggggctggaa agagggtatg tgctggttct 1380
cttcaggcaa tgttaatagc gtgcccgacg attggtaggc tggtgcagga gtttgagtgg 1440
aagctgagag atggagaaga agaaaatgta gatactgttg ggctcaccac tcacaaacgc 1500
tatccaatgc atgcaatcct gaagccaaga agtta                             1535

SEQ ID NO: 64
Artificial Sequence
atggctacct tgttggaaca tttttcaagct atgccattcg ctattccaat tgctttggct   60
gctttgtctt ggttgttttt gttctacatc aaggtttctt tcttctccaa caaatccgct  120
caagctaaat tgccaccagt tccagttgtt ccaggtttgc cagttattgg taatttgttg  180
caattgaaag aaaagaagcc ataccaaacc ttcactagat gggctgaaga atatggtcca  240
atctactcta ttagaactgg tgcttctact atggttgtct tgaacactac tcaagttgca  300
aaagaagcta tggttaccag atacttgtct atctctacca gaaagttgtc caacgccttg  360
aaaattttga ccgctgataa gtgcatggtt gccattctg attacaacga tttccacaag  420
atgatcaaga gatatatctt gtctaacgtt ttgggtccat ctgcccaaaa aagacataga  480
tctaacagag ataccttgag agccaacgtt tgttctagat gcattccca gttaagaac   540
tctccaagag aagctgtcaa cttagaaga gttttcgaat gggaattatt cggtatcgct  600
ttgaaacaag ccttcggtaa ggatattgaa aagccaatct acgtcgaaga attgggtact  660
actttgtcca gagatgaaat cttcaaggtt ttggtcttgg acattatgga aggtgccatt  720
gaagttgatt ggagagattt ttttcccatac ttgcgttgga ttccaaacac cagaatggaa  780
actaagatcc aaagattata cttagaaga aaggccgtta tgaccgcctt gattaacgaa  840
caaaagaaaa gaattgcctc cggtgaagaa atcaactgct acatcgattt cttgttgaaa  900
gaaggtaaga ccttgaccat ggaccaaatc tctatggtct tgtgggaaac cgttattgaa  960
actgctgata ccacaatggt tactactgaa tgggctatgt acgaagttgc taaggattct 1020
aaaagacaag acagattata ccaagaaatc caaaaggtct gcggttctga atggttaca  1080
gaagaatact tgtcccaatt gccatacttg aatgctgttt tccacgaaac tttgagaaaa 1140
cattctccag ctgctttggt tccattgaga tatgctcatg aagatactca attgggtggt 1200
tattacattc cagccggtac tgaaattgcc attaacatct acggtggaa catggacaag 1260
caccaatggg aatctccaga agaatggaag ccagaaagat ttttggatcc taagtttgac 1320
ccaatggact tgtacaaaac tatggctttt ggtgctggta aaagagtttg cgctggttct 1380
ttacaagcta tgttgattgc ttgtccaacc atcggtagat tggttcaaga atttgaatgg 1440
aagttgagag atggtgaaga agaaaacgtt gatactgttg gtttgaccac ccataagaga 1500
tatccaatgc atgctatttt gaagccaaga tcttaa                             1536
```

TABLE 19-continued

Sequences disclosed herein.

SEQ ID NO: 65
Artificial Sequence

```
aagcttacta gtaaaatggc ctccatcacc catttcttac aagattttca agctactcca     60
ttcgctactg cttttgctgt tggtggtgtt tctttgttga tattcttctt cttcatccgt    120
ggtttccact ctactaagaa aaacgaatat tacaagttgc caccagttcc agttgttcca    180
ggtttgccag ttgttggtaa tttgttgcaa ttgaaagaaa agaagccata caagactttc    240
ttgagatggg ctgaaattca tggtccaatc tactctatta gaactggtgc ttctaccatg    300
gttgttgtta actctactca tgttgccaaa gaagctatgg ttaccagatt ctcttcaatc    360
tctaccagaa agttgtccaa ggctttgaa ttattgacct ccaacaaatc tatggttgcc    420
acctctgatt acaacgaatt tcacaagatg gtcaagaagt acatcttggc cgaattattg    480
ggtgctaatg ctcaaaagag acacagaatt catagagaca cctgatcga aaacgtcttg    540
aacaaattgc atgcccatac caagaattct ccattgcaag ctgttaactt cagaaagatc    600
ttcgaatctg aattattcgg tttggctatg aagcaagcct tgggttatga tgttgattcc    660
ttgttcgttg aagaattggg tactaccttg tccagagaag aaatctacaa cgttttggtc    720
agtgacatgt tgaagggtgc tattgaagtt gattggagag acttttttcc atacttgaaa    780
tggatcccaa acaagtcctt cgaaatgaag attcaaagat tggcctctag aagacaagcc    840
gttatgaact ctattgtcaa agaacaaaag aagtccattg cctctggtaa gggtgaaaac    900
tgttacttga attacttgtt gtccgaagct aagactttga ccgaaaagca aatttccatt    960
ttggcctggg aaaccattat tgaaactgct gatacaactg ttgttaccac tgaatgggct   1020
atgtacgaat tggctaaaaa cccaaagcaa caagacagat tatacaacga aatccaaaac   1080
gtctgcggta ctgataagat taccgaagaa catttgtcca agttgccta cttgtctgct   1140
gtttttcacg aaaccttgag aaagtattct ccatctccat tggttccatt gagatacgct   1200
catgaagata ctcaattggg tggttattat gttccagcg gtactgaaat tgctgttaat   1260
atctacggtt gcaacatgga caagaatcaa tgggaaactc cagaagaatg gaagccagaa   1320
agattttttgg acgaaaagta cgatccaatg gacatgtaca agactatgtc ttttggttcc   1380
ggtaaaagag tttgcgctgg ttcttttacaa gctagtttga ttgcttgtac ctccatcggt   1440
agattggttc aagaatttga atggagattg aaagacggtg aagttgaaaa cgttgatacc   1500
tgggtttga ctacccataa gttgtatcca atgcaagcta tcttgcaacc tagaaactga   1560
ctcgagccgc gg                                                       1572
```

SEQ ID NO: 66
Castanea mollissima

```
MASITHFLQD FQATPPATAF AVGGVSLLIF FFFIRGFHST KKNEYYKLPP VPVVPGLPVV     60
GNLLQLKEKK PYKTFLRWAE IHGPIYSIRT GASTMVVVNS THVAKEAMVT RFSSISTRKL    120
SKALELLTSN KSMVATSDYN EFHKMVKKYI LAELLGANAQ KRHRIHRDTL IENVLNKLHA    180
HTKNSPLQAV NFRKIFESEL FGLAMKQALG YDVDSLFVEE LGTTLSREEI YNVLVSDMLK    240
GAIEVDWRDF FPYLKWIPNK SFEMKIQRLA SRRQAVMNSI VKEQKKSIAS GKGENCYLNY    300
LLSEAKTLTE KQISILAWET IIETADTTVV TTEWAMYELA KNPKQQDRLY NEIQNVCGTD    360
KITEEHLSKL PYLSAVFHET LRKYSPSPLV PLRYAHEDTQ LGGYYVPAGT EIAVNIYGCN    420
MDKNQWETPE EWKPERFLDE KYDPMDMYKT MSFGSGKRVC AGSLQASLIA CTSIGRLVQE    480
FEWRLKDGEV ENVDTLGLTT HKLYPMQAIL QPRN                                514
```

SEQ ID NO: 67
Artificial Sequence

```
atgatttcct tgttgttggg ttttgttgtc tcctccttct tgtttatctt cttcttgaaa     60
aaattgttgt tctccttcag tcgtcacaaa atgtccgaag tttctagatt gccatctgtt    120
ccagttccag gttttccatt gattggtaac ttgttgcaat tgaaagaaaa gaagccacac    180
aagactttca ccaagtggtc tgaattatat ggtccaatct actctatcaa gatgggttcc    240
tcttctttga tcgtcttgaa ctctcattgaa accgccaaag aagctatggt cagtagattc    300
tcttcaatct ctaccagaaa gttgtctaac gctttgactg tttttgacctg caacaaatct    360
atggttgcta cctctgatta cgatgacttt cataagttcg tcaagagatg cttgttgaac    420
ggtttgttgg gtgctaatgc tcaagaaaga aaaagacatt acagagatgc cttgatcgaa    480
aacgttacct ctaaattgca tgcccatacc agaaatcatc cacaagaacc agttaacttc    540
agagccattt tcgaacacga attattcggt gttgctttga acaagccttc cggtaaagat    600
gtcgaatcca tctatgtaaa agaattgggt gtcaccttgt ccagagatga atttttcaag    660
gttttggtcc acgacatgat ggaagtgct attgatgttg attggagaga ttcttccca    720
tacttgaaat ggatcccaaa caactctttc gaagccagaa ttcaacaaaa gcacaagaga    780
agattggctg ttatgaacgc cttgatccaa gacagattga atcaaaacga ttccgaatcc    840
gatgatgact gctacttgaa tttccttgatg tctgaagcta gaccttgac catgaacaa    900
attgctattt ggtttggga accattatc gaaactgctg ataccacttt ggttactact    960
gaatgggcta tgtacgaatt ggccaaacat caatctgttc aagatagatt attcaaagaa   1020
atccaatccg tctgcggtgg tgaaaagatc aaagaagaac aattgccaag attgccttac   1080
gtcaatggtg tttttcacga aaccttgaga aagtattctc cagctccatt ggttccaatt   1140
agatacgctc atgaagatac ccaaattggt ggttatcata ttccagcggg ttctgaaatt   1200
gccattaaca tctacggttg caacatggat aagaagat gggaaagacc tgaagaatgg   1260
tggccagaaa gatttttgga agatagatac gaatcctccg acttgcataa gactatggct   1320
tttggtgctg taaaagagt ttgtgctggt gctttacaag ctagtttgat ggctggtatt   1380
gctatccgta gattggttca agaattcgaa tggaagttga gagatggtga agaagaaaac   1440
gttgatactt acgtttgac ctcccaaaag ttgtatccat gatggccat tatcaaccca   1500
agaagatctt aa                                                      1512
```

SEQ ID NO: 68
Thellungiella halophila

```
MASMISLLLG FVVSSFLFIF FLKKLLFFFS RHKMSEVSRL PSVPVPGFPL IGNLLQLKEK     60
KPHKTFTKWS ELYGPIYSIK MGSSSLIVLN SIETAKEAMV SRFSSISTRK LSNALTVLTC    120
NKSMVATSDY DDFHKFVKRC LLNGLLGANA QERKRHYRDA LIENVTSKLH AHTRNHPQEP    180
VNFRAIFEHE LFGVALKQAF GKDVESIYVK ELGVTLSRDE IFKVLVHDMM EGAIDVDWRD    240
FFPYLKWIPN NSFEARIQQK HKRRLAVMNA LIQDRLNQND SESDDCYLN FLMSEAKTLT    300
```

TABLE 19-continued

Sequences disclosed herein.

```
MEQIAILVWE TIIETADTTL VTTEWAMYEL AKHQSVQDRL FKEIQSVCGG EKIKEEQLPR   360
LPYVNGVFHE TLRKYSPAPL VPIRYAHEDT QIGGYHIPAG SEIAINIYGC NMDKKRWERP   420
EEWWPERFLE DRYESSDLHK TMAFGAGKRV CAGALQASLM AGIAIGRLVQ EFEWKLRDGE   480
EENVDTYGLT SQKLYPLMAI INPRRS                                       506

SEQ ID NO: 69
Artificial Sequence
aagcttacta gtaaaatgga catgatgggt attgaagctg ttccatttgc tactgctgtt    60
gttttgggtg gtatttcctt ggttgttttg atcttcatca gaagattcgt ttccaacaga   120
aagagatccg ttgaaggttt gccaccagtt ccagatattc aggtttacc attgattggt    180
aacttgttgc aattgaaaga aaagaagcca cataagacct ttgctagatg ggctgaaact   240
tacggtccaa ttttctctat tagaactggt gcttctacca tgatcgtctt gaattcttct   300
gaagttgcca agaagctat ggtcactaga ttctcttcaa tctctaccag aaagttgtcc    360
aacgccttga agattttgac cttcgataag tgtatggttg ccacctctga ttacaacgat   420
tttcacaaaa tggtcaaggg tttcatcttg agaaacgttt taggtgctcc agcccaaaaa   480
agacatagat gtcatagaga taccttgatc gaaaacatct ctaagtactt gcatgcccat   540
gttaagactt ctccattgga accagttgtc ttgaagaaga ttttcgaatc cgaaattttc   600
ggtttggctt tgaaacaagc cttgggtaag gatatcgaat ccatctatgt tgaagaattg   660
ggtactacct tgtccagaga agaaattttt gccgttttgg ttgttgatcc aatggctggt   720
gctattgaag ttgattggag agatttttc ccatacttgt cctggattcc aaacaagtct   780
atggaaatga agatccaaag aatggatttt agaagaggtg ctttgatgaa ggccttgatt   840
ggtgaacaaa agaaaagaat cggttccggt gaagaaaaga actcctacat tgatttcttg   900
ttgtctgaag ctaccacttt gaccgaaaag caaattgcta tgttgatctg ggaaaccatc   960
atcgaaattt ccgatacaac tttggttacc tctgaatggg ctatgtacga attggctaaa  1020
gacccaaata gacaagaaat cttgtacaga gaaatccaca aggtttgcgg ttctaacaag  1080
ttgactgaag aaaacttgtc caagttgcca tacttgaact ctgttttcca cgaaaccttg  1140
agaaagtatt ctccagctcc aatggttcca gttagatatg ctcatgaaga tactcaattg  1200
ggtggttacc atattccagc tggttctcaa attgccatta acatctacgg ttgcaacatg  1260
aacaaaaagc aatgggaaaa tcctgaagaa tggaagccag aaagattctt ggacgaaaag  1320
tatgacttga tggacttgca taagactatg gcttttggtg gtggtaaaag agttgtgct   1380
ggtgctttac aagcaatgtt gattgcttgc acttccatcg gtagattcgt tcaagaatt    1440
gaatggaagt tgatgggtgg tgaagaagaa acgttgata ctgttgcttt gacctcccaa    1500
aaattgcatc caatgcaagc cattattaag gccagagaat gactcgagcc gcgg         1554

SEQ ID NO: 70
Vitis vinifera
MDMMGIEAVP FATAVVLGGI SLVVLIFIRR FVSNRKRSVE GLPPVPDIPG LPLIGNLLQL    60
KEKKPHKTFA RWAETYGPIF SIRTGASTMI VLNSSEVAKE AMVTRFSSIS TRKLSNALKI   120
LTFDKCMVAT SDYNDFHKMV KGFILRNVLG APAQKRHRCH RDTLIENISK YLHAHVKTSP   180
LEPVVLKKIF ESEIFGLALK QALGKDIESI YVEELGTTLS REEIFAVLVV DPMAGAIEVD   240
WRDFFPYLSW IPNKSMEMKI QRMDFRRGAL MKALIGEQKK RIGSGEEKNS YIDFLLSEAT   300
TLTEKQIAML IWETIIEISD TTLVTSEWAM YELAKDPNRQ EILYREIHKV CGSNKLTEEN   360
LSKLPYLNSV FHETLRKYSP APMVPVRYAH EDTQLGGYHI PAGSQIAINI YGCNMNKKQW   420
ENPEEWKPER FLDEKYDLMD LHKTMAFGGG KRVCAGALQA MLIACTSIGR FVQEFEWKLM   480
GGEEENVDTV ALTSQKLHPM QAIIKARE                                     508

SEQ ID NO: 71
Artificial Sequence
aagcttaaaa tgagtaagtc taatagtatg aattctacat cacacgaaac cctttttcaa    60
caattggtct tgggtttgga ccgtatgcca ttgatggatg ttcactggtt gatctacgtt   120
gctttcggcg catggttatg ttcttatgtg atacatgttt tatcatcttc ctctacagta   180
aaagtgccag ttgttggata caggtctgta ttcgaaccta catggttgct tagacttaga   240
ttcgtctggg aaggtggctc tatcataggt caagggtaca ataagtttaa agactctatt   300
ttccaagtta ggaaattggg aactgatatt gtcattataa cacctaacta tattgatgaa   360
gtgagaaaat tgtcacagga caagactaga tcagttgaac cttttcattaa tgattttgca   420
ggtcaataca caagaggcat ggttttcttg caatctgact tacaaaaccg tgttatacaa   480
caaagactaa ctccaaaatt ggtttccttg accaaggtca tgaaggaaga gttggattat   540
gctttaacaa aagagatgcc tgatatgaaa aatgacgaat gggtagaagt agatatcagt   600
agtataatgg ttgagattgat ttccaggatc tccgccagag tctttctagg gcctgaaccat  660
tgtcgtaacc aggaatggtt gactactaca gcagaatatt cagaatcact tttcattaca   720
gggtttatct taagagttgt acctcatatc ttaagaccat tcatcgcccc tctattacct   780
tcatacagga ctctacttag aaacgtttca agtggtagaa gagtcatcgg tgacatcata   840
agatctcagc aaggggatgg taacgaagat atactttcct ggatgagaga tgctgccaca   900
ggagaggaaa agcaaatcga taacattgct cagagaatgt taattcttc tttagcatca    960
atccacacta ctgcgatgac catgacacat gccatgcaga atctatgtgc ttgccctgag  1020
tacattgaac cattaagaga tgaagttaaa tctgttgttg gggcttctgg ctgggacaag  1080
acagcgttaa acagatttca taagttggac tccttcctaa aagagtcaca aagattcaac  1140
ccagtattct tattgacatt caatagaatc taccatcaat ctatgacctt atcagatggc  1200
actaacattc catctggaac acgtattgct gttccatcac acgcaatgtt gcaagattct  1260
gcacatgtcc caggtccaac ccacctact gaatttgatg gattcagata tagtaagata  1320
cgttctgata gtaactacgc acaaaagtac ctattctcca tgaccgattc ttcaaacatg  1380
gctttcggat acgcaagta tgcttgtcca ggtagatttt acgcgtctaa tgagatgaaa  1440
ctaacattag ccatttttgtt gctacaattt gagttcaaac taccagatgg taaaggtcgt  1500
cctagaaata tcactatcga ttctgatatg attccagacc aagagctag actttgcgtc   1560
agaaaaagat cacttagaga tgaatgaccg cgg                                1593
```

TABLE 19-continued

Sequences disclosed herein.

```
SEQ ID NO: 72
Gibberella fujikuroi
MSKSNSMNST SHETLFQQLV LGLDRMPLMD VHWLIYVAFG AWLCSYVIHV LSSSSTVKVP    60
VVGYRSVFEP TWLLRLRFVW EGGSIIGQGY NKFKDSIFQV RKLGTDIVII PPNYIDEVRK   120
LSQDKTRSVE PFINDFAGQY TRGMVFLQSD LQNRVIQQRL TPKLVSLTKV MKEELDYALT   180
KEMPDMKNDE WVEVDISSIM VRLISRISAR VFLGPEHCRN QEWLTTTAEY SESLFITGFI   240
LRVVPHILRP FIAPLLPSYR TLLRNVSSGR RVIGDIIRSQ QGDGNEDILS WMRDAATGEE   300
KQIDNIAQRM LILSLASIHT TAMTMTHAMY DLCACPEYIE PLRDEVKSVV GASGWDKTAL   360
NRFHKLDSFL KESQRFNPVF LLTFNRIYHQ SMTLSDGTNI PSGTRIAVPS HAMLQDSAHV   420
PGPTPPTEFD GFRYSKIRSD SNYAQKYLFS MTDSSNMAFG YGKYACPGRF YASNEMKLTL   480
AILLLQFEFK LPDGKGRPRN ITIDSDMIPD PRARLCVRKR SLRDE                  525

SEQ ID NO: 73
Artificial Sequence
aagcttaaaa tggaagatcc tactgtctta tatgcttgtc ttgccattgc agttgcaact    60
ttcgttgtta gatggtacag agatccattg agatccatcc caacagttgg tggttccgat   120
ttgcctattc tatcttacat cggcgcacta agatggacaa gacgtggcag agagatactt   180
caagagggat atgatggcta cagaggatct acattcaaaa tcgcgatgtt agaccgttgg   240
atcgtgatcg caaatggtcc taaactagct gatgaagtca gacgtagacc agatgaagag   300
ttaaacttta tggacggatt aggagccatt gtccaaacta gtacaccttt aggtgaagct   360
attcataacg atccataccc tgtcgatatc ataagagaaa aactaacaag aggccttcca   420
gccgtgcttc ctgatgtcat tgaagagttg acacttgcgg ttagacagta cattccaaca   480
gaaggtgatg aatgggtgtc cgtaaactgt tcaaaggccg caagagatat tgttgctaga   540
gcttctaata gagtctttgt aggtttgcct gcttgcagaa accaaggtta cttagatttg   600
gcaatagact ttacattgtc tgttgtcaag gatagagcca tcatcaatat gtttccagaa   660
ttgttgaagc caatagttgg cagagttgta ggtaacgcca ccagaaatgt tcgtagagct   720
gttccttttg ttgctccatt ggtggaggaa agacgtagac ttatggaaga gtacggtgaa   780
gactggtctg aaaaacctaa tgatatgtta cagtggataa tggatgaagc tgcatccaga   840
gatagttcag tgaaggcaat cgcagagaga ttgttaatgg tgaacttcgc ggctattcat   900
acctcatcaa acactatcac tcatgctttg taccaccttg ccgaaatgcc tgaaactttg   960
caaccactta gagaagagat cgaaccatta gtcaaagagg agggctggac caaggctgct  1020
atgggaaaaa tgtggtggtt agattcattt ctaagagaat ctcaaagata caatggcatt  1080
aacatcgtat ctttaactag aatggctgac aaagatatta cattgagtga tggcacattt  1140
ttgccaaaag gtactctagt ggccgttcca gcgtattcta ctcatagaga tgatgctgtc  1200
tacgctgatg ccttagtatt cgatcctttc agattctcac gtatgagagc gagagaaggt  1260
gaaggtacaa agcaccagtt cgttaatact tcagtcgatc acgttccatt tggtcacgga  1320
aagcatgctt gtccaggaag attcttcgcc gcaaacgaat tgaaagcaat gttggcttac  1380
attgttctaa actatgatgt aaagttgcct ggtgacggta aacgtccatt gaacatgtat  1440
tggggtccaa cagttttgcc tgcaccagca ggccaagtat tgttcagaaa gagacaagtt  1500
agtctataac cgcgg                                                  1515

SEQ ID NO: 74
Trametes versicolor
MEDPTVLYAC LAIAVATFVV RWYRDPLRSI PTVGGSDLPI LSYIGALRWT RRGREILQEG    60
YDGYRGSTFK IAMLDRWIVI ANGPKLADEV RRRPDEELNF MDGLGAFVQT KYTLGEAIHN   120
DPYHVDIIRE KLTRGLPAVL PDVIEELTLA VRQYIPTEGD EWVSVNCSKA ARDIVARASN   180
RVFVGLPACR NQGYLDLAID FTLSVVKDRA IINMFPELLK PIVGRVVGNA TRNVRRAVPF   240
VAPLVEERRR LMEEYGEDWS EKPNDMLQWI MDEAASRDSS VKAIAERLLM VNFAAIHTSS   300
NTITHALYHL AEMPETLQPL REEIEPLVKE EGWTKAAMGK MWWLDSFLRE SQRYNGINIV   360
SLTRMADKDI TLSDGTFLPK GTLVAVPAYS THRDDAVYAD ALVFDPFRFS RMRAREGEGT   420
KHQFVNTSVE YVPFGHGKHA CPGRFFAANE LKAMLAYIVL NYDVKLPGDG KRPLNMYWGP   480
TVLPAPAGQV LFRKRQVSL                                              499

SEQ ID NO: 75
Artificial Sequence
atggcatttt tctctatgat ttcaattttg ttgggatttg ttatttcttc tttcatcttc    60
atcttttttct tcaaaaagtt acttagtttt agtaggaaaa acatgtcaga agtttctact   120
ttgccaagtg ttccagtagt gcctggtttt ccagttattg ggaatttgtt gcaactaaag   180
gagaaaaagc ctcataaaac tttcactaga tggtcagaga tatatggacc tatctactct   240
ataaagatgg ttcttcatc tcttattgta ttgaacagta cagaaactgc taaggaagca   300
atggtcacta gattttcatc aatatctacc agaaaattgt aaacgcccct aacagttcta   360
acctgcgata agtctatggt cgccacttct gattatgatg acttccacaa attagttaag   420
agatgtttgc taaatggact tcttggtgct aatgctcaaa agagaaaaag acactacaga   480
gatgctttga ttgaaaatgt gagttccaag ctacatgcac acgctagaga tcatccacaa   540
gagccagtta acttagagc aattttcgaa cacgaattgt ttggtgtagc attaaagcaa   600
gccttcggta aagacgtaga atccatatac gtcaaggagt taggcgtaac attatcaaaa   660
gatgaaatct ttaaggtgct tgtacatgat atgatggagg gtgcaattga tgtagattgg   720
agagatttct tcccatattt gaaatggatc cctaataagt cttttgaagc taggatacaa   780
caaagcacac agaaagact agctgttatg aacgcactta cagagacag attgaagcaa   840
aatgggtctg aatcagatga tgattgttac cttaacttct taatgtctga ggctaaaaca   900
ttgactaagg aacagatcgc aatccttgtc tgggaaacaa tcattgaaac agcagatact   960
accttagtca caactgaatg ggccatatac gagctagcca acatccatc tgtgcaagat  1020
aggttgtcta aggagatcca gactgtgtgt ggtggagaa aattcaagga agacagttg  1080
tcacaagttc cttaccttaa cggcgttttc catgaaacct tgagaaaata ctcacctgca  1140
ccattagttc ctattagata cgcccacgaa gatacacaaa tcgtggcta ccatgttcca  1200
gctgggtccg aaattgctat aaacatctac gggtgcaaca tggacaaaaa gagatggaa  1260
agaccagaag attggtggcc agaaagattc ttagatgatg gcaaatatga aacatctgat  1320
ttgcataaaa caatggcttt cggagctggc aaaagagtgt gtgccggtgc tctacaagcc  1380
```

TABLE 19-continued

Sequences disclosed herein.

```
tccctaatgg ctggtatcgc tattggtaga ttggtccaag agttcgaatg gaaacttaga   1440
gatggtgaag aggaaaatgt cgatacttat gggttaacat ctcaaaagtt atacccacta   1500
atggcaatca tcaatcctag aagatcctaa                                    1530
```

SEQ ID NO: 76
Arabidopsis thaliana
```
MAFFSMISIL LGFVISSFIF IFFFKKLLSF SRKNMSEVST LPSVPVVPGF PVIGNLLQLK    60
EKKPHKTFTR WSEIYGPIYS IKMGSSSLIV LNSTETAKEA MVTRFSSIST RKLSNALTVL   120
TCDKSMVATS DYDDFHKLVK RCLLNGLLGA NAQKRKRHYR DALIENVSSK LHAHARDHPQ   180
EPVNFRAIFE HELFGVALKQ AFGKDVESIY VKELGVTLSK DEIFKVLVHD MMEGAIDVDW   240
RDFFPYLKWI PNKSFEARIQ QKHKRRLAVM NALIQDRLKQ NGSESDDDCY LNFLMSEAKT   300
LTKEQIAILV WETIIETADT TLVTTEWAIY ELAKHPSVQD RLCKEIQNVC GGEKFKEEQL   360
SQVPYLNGVF HETLRKYSPA PLVPIRYAHE DTQIGGYHVP AGSEIAINIY GCNMDKKRWE   420
RPEDWWPERF LDDGKYETSD LHKTMAFGAG KRVCAGALQA SLMAGIAIGR LVQEFEWKLR   480
DGEEENVDTY GLTSQKLYPL MAIINPRRS                                    509
```

SEQ ID NO: 77
Artificial Sequence
```
atgcaatcag attcagtcaa agtctctcca tttgatttgg tttccgctgc tatgaatggc    60
aaggcaatgg aaaagttgaa cgctagtgaa tctgaagatc caacaacatt gcctgcacta   120
aagatgctag ttgaaaatag agaattgttg acactgttca caacttcctt cgcagttctt   180
attgggtgtc ttgtatttct aatgtggaga cgttcatcct ctaaaaagct ggtacaagat   240
ccagttccac aagttatcgt tgtaaagaag aaagagaagg agtcagaggt tgatgacggg   300
aaaaagaaag tttctatttt ctacggcaca caaacaggaa ctgccgaagg ttttgctaaa   360
gcattagtcg aggaagcaaa agtgagatat gaaaagacct cttcaaggt tatcgatcta   420
gatgactacg ctgcagatga tgatgaatat gaggaaaaac tgaaaaagga atccttagcc   480
ttcttcttct tggccacata cggtgatggt gaacctactg ataatgctgc taacttctac   540
aagtggttca cagaaggcga cgataaaggt gaatggctga aaaagttaca atacggagta   600
tttggtttag gtaacagaca atatgaacat ttcaacaaga tcgctattgt agttgatgat   660
aaacttactg aaatgggagc caaaagatta gtaccagtag gattagggga tgatgatcag   720
tgtatagaag atgacttcac cgcctggaag gaattggtat ggccagaatt ggatcaactt   780
ttaagggacg aagatgatac ttctgtgact accccataca ctgcagccgt attggagtac   840
agagtggttt accatgataa accagcagac tcatatgctg aagatcaaac ccatacaaac   900
ggtcatgttg tccatgatgc acagcatcct tcaagatcta atgtggcttt caaaaaggaa   960
ctacacacct tcaatcaga taggtcttgt actcacttag aattcgatat ttctcacaca  1020
ggactgtctt acgaaactgg cgatcacgtt ggcgtttatt ccgagaactt gtccgaagtt  1080
gtcgatgaag cactaaaact gttaggtta tcaccagaca catacttctc agtccatgct  1140
gataaggagg atgggacacc tatcggtggt gcttcactac caccccttt tcctccttgc  1200
acattgagag acgctctaac cagatacgca gatgtctat cctcacctaa aaaggtagct  1260
ttgctggcat tggctgctca tgctagtgac cctagtgaag gcgataggtt aaagttcctg  1320
gcttcaccag ccggaaaaga tgaatatgca caatggatcg tcgccaacca acgttctttg  1380
ctagaagtga tgcaaagttt tccatctgcc aagcctccat taggtgtgtt cttcgcagca  1440
gtagctccac gtttacaacc aagatactac tctatcagtt catctcctaa gatgtctcct  1500
aacagaatac atgttacatg tgctttggtg tacgagacta ctccagcagg cagaattcac  1560
agaggattgt gttcaacctg gatgaaaaat gctgtcctt aacagagtc acctgattgc  1620
tctcaagcat ccattttcgt tagaacatca aatttcagac ttccagtgga tccaaaagtt  1680
ccagtcatta tgataggacc aggcactggt cttgccccat tcaggggctt tcttcaagag  1740
agattggcct tgaaggaatc tggtacagaa ttgggttcct ctatcttttt ctttggttgc  1800
cgtaatagaa aagttgactt tatctacagg gacgagctta acaattttgt tgagacagga  1860
gcattgtcag aattgatcgt cgcattttca agagaaggga ctgccaaaga gtacgttcag  1920
cacaagatga gtcaaaaagc ctccgatata tggaaacttc taagtgaagg tgcctatctt  1980
tatgtctgtg gcgatgcaaa gggcatggcc aaggatgtcc atagaactct gcatacaatt  2040
gttcaggaac aagggagtct ggattcttcc aaggctgaat gtacgtcaa aaacttacag  2100
atgtctggaa gatacttaag agatgtttgg taa                               2133
```

SEQ ID NO: 78
Stevia rebaudiana
```
MQSDSVKVSP FDLVSAAMNG KAMEKLNASE SEDPTTLPAL KMLVENRELL TLFTTSFAVL    60
IGCLVFLMWR RSSSKKLVQD PVPQVIVVKK KEKESEVDDG KKKVSIFYGT QTGTAEGFAK   120
ALVEEAKVRY EKTSFKVIDL DDYAADDDEY EEKLKKESLA FFFLATYGDG EPTDNAANFY   180
KWFTEGDDKG EWLKKLQYGV FGLGNRQYEH FNKIAIVVDD KLTEMGAKRL VPVGLGDDDQ   240
CIEDDFTAWK ELVWPELDQL LRDEDDTSVT TPYTAAVLEY RVVYHDKPAD SYAEDQTHTN   300
GHVVHDAQHP SRSNVAFKKE LHTSQSDRSC THLEFDISHT GLSYETGDHV GVYSENLSEV   360
VDEALKLLGL SPDTYFSVHA DKEDGTPIGG ASLPPPFPPC TLRDALTRYA DVLSSPKKVA   420
LLALAAHASD PSEADRLKFL ASPAGKDEYA QWIVANQRSL LEVMQSFPSA KPPLGVFFAA   480
VAPRLQPRYY SISSSPKMSP NRIHVTCALV YETTPAGRIH RGLCSTWMKN AVPLTESPDC   540
SQASIFVRTS NFRLPVDPKV PVIMIGPGTG LAPFRGFLQE RLALKESGTE LGSSIFFFGC   600
RNRKVDFIYE DELNNFVETG ALSELIVAFS REGTAKEYVQ HKMSQKASDI WKLLSEGAYL   660
YVCGDAKGMA KDVHRTLHTI VQEQGSLDSS KAELYVKNLQ MSGRYLRDVW              710
```

SEQ ID NO: 79
Siraitia grosvenorii
```
atgaaggtca gtcattcga attcatgtcc gctattatca agggtagaat ggacccatct    60
aactcctcat ttgaatctac tggtgaagtt gcctccgtta tctttgaaaa cagagaattg   120
gttgccatct tgaccacttc tattgctgtt atgattggtt gcttcgttgt cttgatgtgg   180
agaagagctg ttctagaaa ggttaagaat gtcgaattgc caaagccatt gattgtccat   240
gaaccagaac tgaagttga agatggtaag aagaaggttt ccatcttctt cggtactcaa   300
actggtactg ctgaaggttt tgctaaggct ttggctgatg aagctaaagc tagatacgaa   360
```

TABLE 19-continued

Sequences disclosed herein.

```
aaggctacct tcagagttgt tgatttggat gattatgctg ccgatgatga ccaatacgaa   420
gaaaaattga agaacgaatc cttcgccgtt ttcttgttgg ctacttatgg tgatggtgaa   480
cctactgata atgctgctag attttacaag tggttcgccg aaggtaaaga aagaggtgaa   540
tggttgcaaa acttgcacta tgctgttttt ggtttgggta acagacaata cgaacacttc   600
aacaagattg ctaaggttgc cgacgaatta ttggaagctc aaggtggtaa tagattggtt   660
aaggttggtt taggtgatga cgatcaatgc atcgaagatg attttctgc ttggagagaa   720
tctttgtggc cagaattgga tatgttgttg agagatgaag atgatgctac tactgttact   780
actccatata ctgctgctgt cttggaatac agagttgtct ttcatgattc tgctgatgtt   840
gctgctgaag ataagtcttg gattaacgct aatggtcatg ctgttcatga tgctcaacat   900
ccattcagat ctaacgttgt cgtcagaaaa gaattgcata cttctgcctc tgatagatcc   960
tgttctcatt tggaattcaa catttccggt tccgctttga attacgaaac tggtgatcat  1020
gttggtgtct actgtgaaaa cttgactgaa actgttgatg aagccttgaa cttgttgggt  1080
ttgtctccag aaacttactt ctctatctac accgataacg aagatggtac tccattgggt  1140
ggttcttcat tgccaccacc atttccatca tgtactttga gaactgcttt gaccagatac  1200
gctgatttgt tgaactctcc aaaaaagtct gctttgttcg cttttagctgc tcatgcttct  1260
aatccagttg aagctgatag attgagatac ttggcttctc cagctggtaa agatgaatat  1320
gcccaatctg ttatcggttc ccaaaagtct ttgttgaag ttatggctga attcccatct  1380
gctaaaccac cattaggtgt ttttttttgct gctgttgctc caagattgca acctagattc  1440
tactccattt catcctctcc aagaatggct ccatctagaa tccatgttac ttgtgctttg  1500
gtttacgata agatgccaac tggtagaatt cataagggtg tttgttctac ctggatgaag  1560
aattctgttc caatggaaaa gtcccatgaa tgttctgggg ctccaatttt cgttagacaa  1620
tccaatttta agttgccagc cgaatccaag gttccaatta tcatggttgg tccaggtact  1680
ggtttggctc ctttagagg ttttttacaa gaaagattgg ccttgaaaga atccggtgtt  1740
gaattgggtc catccatttt gttttttcggt tgcagaaaca gaagaatgga ttacatctac  1800
gaagatgaat tgaacaactt cgttgaaacc ggtgctttgt ccgaattggt tattgctttt  1860
tctagagaag gtcctaccaa agaatacgtc caacataaga tggctgaaaa ggcttctgat  1920
atctggaact tgatttctga aggtgcttac ttgtacgttt gtggtgatgc taaaggtatg  1980
gctaaggatg ttcatagaac cttgcatacc atcatgcaag aacaaggttc tttgattct   2040
tccaaagctg aatccatggt caagaacttg caaatgaatg gtagatactt aagagatgtt  2100
tggtaa                                                              2106

SEQ ID NO: 80
Siraitia grosvenorii
MKVSPFEFMS AIIKGRMDPS NSSFESTGEV ASVIFENREL VAILTTSIAV MIGCFVVLMW    60
RRAGSRKVKN VELPKPLIVH EPEPEVEDGK KKVSIFFGTQ TGTAEGFAKA LADEAKARYE   120
KATFRVVDLD DYAADDDQYE EKLKNESFAV FLLATYGDGE PTDNAARFYK WFAEGKERGE   180
WLQNLHYAVF GLGNRQYEHF NKIAKVADEL LEAQGGNRLV KVGLGDDDQC IEDDFSAWRE   240
SLWPELDMLL RDEDDATTVT TPYTAAVLEY RVVPHDSADV AAEDKSWINA NGHAVHDAQH   300
PFRSNVVRK ELHTSASDRS CSHLEFNISG SALNYETGDH VGVYCENLTE TVDEALNLLG    360
LSPETYFSIY TDNEDGTPLG GSSLPPPFPS CTLRTALTRY ADLLNSPKKS ALLALAAHAS   420
NPVEADRLRY LASPAGKDEY AQSVIGSQKS LLEVMAEFPS AKPPLGVFFA AVAPRLQPRF   480
YSISSSPRMA PSRIHVTCAL VYDKMPTGRI HKGVCSTWMK NSVPMEKSHE CSWAPIFVRQ   540
SNFKLPAESK VPIIMVGPGT GLAPFRGFLQ ERLALKESGV ELGPSILFFG CRNRRMDYIY   600
EDELNNFVET GALSELVIAF SREGPTKEYV QHKMAEKASD IWNLISEGAY LYVCGDAKGM   660
AKDVHRTLHT IMQEQGSLDS SKAESMVKNL QMNGRYLRDV W                       701

SEQ ID NO: 81
Artificial Sequence
atggcagaat tagatacact tgatatagta gtattaggtg ttatctttt gggtactgtg    60
gcatacttta ctaagggtaa attgtggggt gttaccaagg atccatacgc taacggattc   120
gctgcaggtg gtgcttccaa gcctggcaga actagaaaca tcgtcgaagc tatggaggaa   180
tcaggtaaaa actgtgttgt tttctacggc agtcaaacag gtacagcgga ggattacgcc   240
tcaagacttg caaaggaagg aaagtccaga ttcggtttga acactatgat cgccgatctca   300
gaagattatg acttcgataa cttagacact gttccatctg ataacatcgt tatgtttgta   360
ttggctactt acggtgaagg cgaaccaaca gataacgccg tggatttcta tgagttcatt   420
actggcgaag atgcctcttt caatgagggc aacgatcctc cactaggtaa cttgaattac   480
gttgcgttcg gtctgggcaa caatacctac gaacactaca actcaatggt caggaacgtt   540
aacaaggctc tagaaaagtt aggagctcat agaattggag aagcaggtga gggtgacgac   600
ggagctggaa ctatggaaga ggacttttta gcttggaaag atccaatgtg gaagccttg    660
gctaaaaaga tgggcttgga ggaaagagaa gctgtatatg aacctatttt cgctatcaat   720
gagagagatg atttgacccc tgaagcgaat gaggtatact tgggagaacc taataagcta   780
cacttggaag gtacagcgaa aggtccattc aactcccaca acccatatat cgcaccaatt   840
gcagaatcat acgaactttt ctcagctaag gatagaaatt gtctgcatat ggaaattgat   900
atttctggta gtaatctaaa gtatgaaaca ggcgaccata tcgcgatctg gcctaccaac   960
ccaggtgaag aggtcaacaa atttcttgac atttcagttc tgtctggtaa gcaacattcc  1020
gtcgtaacag tgaaagccttt agaacctaca gccaagttc cttttccaaa tccaactacc  1080
tacgatgcta tattgagata ccatctggaa atatgcgctc cagttctag acagtttgtc  1140
tcaacttag cagcattcgc ccctaatgat gatatcaaag ctgagatgaa ccgtttggga  1200
tcagacaaag attacttcca cgaaaagaca ggaccacatt actacaatat cgctagattt  1260
ttggcctcag tctctaaagg tgaaaaatg acaaagatac cattttctgc tttcatagaa  1320
ggccttacaa aactacaacc aagatactat tctatctctt cctctagttt agttcagcct  1380
aaaaagatta gtattactgc tgttgtcgaa tctcagcaaa ttccaggtag atgaccca    1440
ttcagaggta tagcgactaa ctacttgttc gctttgagga gaaacaaaa cggtgatcca  1500
aatccagctc cttttggcca atcatacgat tgacaggac aaggaataa gtatgatggt  1560
atacatgttc cagtccatgt aagacattct aactttaagc taccatctga tccaggcaaa  1620
cctattatca tgatcggtcc aggtaccggt gttgccccctt tagaggctt cgtccaagag  1680
agggcaaaac aagccagaga tggtgtagaa gttggtaaaa cactgctgtt ctttggatgt  1740
agaaagagta cagaagattt catgtatcaa aaagagtggc aagagtacaa ggaagctctt  1800
```

TABLE 19-continued

Sequences disclosed herein.

```
ggcgacaaat tcgaaatgat tacagctttt tcaagagaag gatctaaaaa ggtttatgtt  1860
caacacagac tgaaggaaag atcaaaggaa gtttctgatc ttctatccca aaaagcatac  1920
ttctacgttt gcggagacgc cgcacatatg gcacgtgaag tgaacactgt gttagcacag  1980
atcatagcag aaggccgtgg tgtatcagaa gccaagggtg aggaaattgt caaaaacatg  2040
agatcagcaa atcaatacca agtgtgttct gatttcgtaa ctttacactg taaagagaca  2100
acatacgcga attcagaatt gcaagaggat gtctggagtt aa                     2142

SEQ ID NO: 82
Gibberella fujikuroi
MAELDTLDIV VLGVIFLGTV AYFTKGKLWG VTKDPYANGF AAGGASKPGR TRNIVEAMEE    60
SGKNCVVFYG SQTGTAEDYA SRLAKEGKSR FGLNTMIADL EDYDFDNLDT VPSDNIVMFV   120
LATYGEGEPT DNAVDFYEFI TGEDASFNEG NDPPLGNLNY VAFGLGNNTY EHYNSMVRNV   180
NKALEKLGAH RIGEAGEGDD GAGTMEEDFL AWKDPMWEAL AKKMGLEERE AVYEPIFAIN   240
ERDDLTPEAN EVYLGEPNKL HLEGTAKGPF NSHNPYIAPI AESYELFSAK DRNCLHMEID   300
ISGSNLKYET GDHIAIWPTN PGEEVNKFLD ILDLSGKQHS VVTVKALEPT AKVPFPNPTT   360
YDAILRYHLE ICAPVSRQFV STLAAFAPND DIKAEMNRLG SDKDYFHEKT GPHYYNIARF   420
LASVSKGEKW TKIPFSAFIE GLTKLQPRYY SISSSSLVQP KKISITAVVE SQQIPGRDDP   480
FRGVATNYLF ALKQKQNGDP NPAPFGQSYE LTGPRNKYDG IHVPVHVRHS NFKLPSDPGK   540
PIIMIGPGTG VAPFRGFVQE RAKQARDGVE VGKTLLFFGC RKSTEDFMYQ KEWQEYKEAL   600
GDKFEMITAF SREGSKKVYV QHRLKERSKE VSDLLSQKAY FYVCGDAAHM AREVNTVLAQ   660
IIAEGRGVSE AKGEEIVKNM RSANQYQVCS DFVTLHCKET TYANSELQED VWS          713

SEQ ID NO: 83
Stevia rebaudiana
atgcaatcgg aatccgttga agcatcgacg attgatttga tgactgctgt tttgaaggac    60
acagtgatcg atacagcgaa cgcatctgat aacggagact caaagatgcc gccggcgttg   120
gcgatgatgt tcgaaattcg tgatctgttg ctgattttga ctacgtcagt tgctgttttg   180
gtcggatgtt tcgttgtttt ggtgtggaag agatcgtccg ggaagaagtc cggcaaggaa   240
ttggagccgc cgaagatcgt tgtgccgaag aggcggctgg agcaggaggt tgatgatggt   300
aagaagaagg ttacgatttt cttcggaaca caaactggaa cggctgaagg tttcgctaag   360
gcactttcg aagaagcgaa agcgcgtat gaaaaggcag cgtttaaagt gattgatttg    420
gatgattatg ctgctgattt ggatgagtat gcagagaagc tgaagaagga acatatgct    480
ttcttcttct tggctacata tggagatggt gagccaactc ataatgctgc caaattttat   540
aaatggttta ctgagggaga cgagaaaggc gtttggcttc aaaaacttca atatggagta   600
tttggtcttg gcaacagaca atatgaacat ttcaacaaga ttggaatagt ggttgatgat   660
ggtctcaccg agcagggtgc aaaacgcatt gttccgttg tcttggaga cgacgatcaa    720
tcaattgaag acgattttc ggcatggaaa gagttagtgt ggcccgaatt ggatctattg    780
cttcgcgatg aagatgacaa agctgctgca actccttaca cagctgcact ccctgaatac   840
cgcgtcgtat ttcatgacaa acccgatgcg ttttctgatg atcatactca aaccaatggt   900
catgctgttc atgatgctca acatccatgc agatccaatg tggctgttaa aaaagagctt   960
catactcctg aatccgatcg ttcatgcaca catcttgaat ttgacatttc tcacactgga  1020
ttatcttatg aaactgggga tcatgttggt gtatactgtg aaaacctaat tgaagtagtg  1080
gaagaagctg ggaaattgtt aggattatca acagatactt atttctcgtt acatattgat  1140
aacgaagatg gttcaccact tggtggacct tcattacaac tccttttcc tccttgtact   1200
ttaagaaaag cattgactaa ttatgcagat ctgttaagct ctcccaaaaa gtcaactttg  1260
cttgctctag ctgctcatgc ttccgatccc actgaagctg atcgtttaag atttcttgca  1320
tctcgcgagg gcaaggatga atatgctgaa tgggttgttg caaaccaaag aagtcttctt  1380
gaagtcatgg aagctttccc gtcagctaga ccgccacttg tgttttctt tgcagcggtt  1440
gcaccgcgtt tacagccgtt tactactct atttcttcct ccccaaagat ggaaccaaac  1500
aggattcatg ttacttgcgc gttggtttat gaaaaaactc ccgcaggtcg tatccacaaa  1560
ggaatctgct caacctggat gaagaacgct gtaccttga ccgaaagtca agattgcagt   1620
tgggcaccga ttttttgttag aacatcaaac ttcagacttc caattgaccc gaaagtcccg  1680
gttatcatga ttggtcctgg aaccggggttg gctccattta ggggttttct tcaagaaaga  1740
ttggctctta aagaatccgg aaccgaactc gggtcatcta ttttattctt cggttgtaga  1800
aaccgcaaag tggattacat atatgagaat gaactcaaca actttgttga aaatggtgcg  1860
ctttctgagc ttgatgttgc tttctcccgc gatggcccga cgaaagaata cgtgcaacat  1920
aaaatgaccc aaaaggcttc tgaaatatgg aatatgcttt ctgagggagc atatttatat  1980
gtatgtggtg atgctaaagg catggctaaa gatgtacacc gtacacttca caccattgtg  2040
caagaacagg gaagtttgga ctcgtctaaa gcggagttgt atgtgaagaa tctacaaatg  2100
tcaggaagat acctccgtga tgtttggtaa                                     2130

SEQ ID NO: 84
Stevia rebaudiana
MQSESVEAST IDLMTAVLKD TVIDTANASD NGDSKMPPAL AMMFEIRDLL LILTTSVAVL    60
VGCFVVLVWK RSSGKKSGKE LEPPKIVVPK RRLEQEVDDG KKKVTIFFGT QTGTAEGFAK   120
ALFEEAKARY EKAAFKVIDL DDYAADLDEY AEKLKKETYA FFFLATYGDG EPTDNAAKFY   180
KWFTEGDEKG VWLQKLQYGV FGLGNRQYEH FNKIGIVVDD GLTEQGAKRI VPVGLGDDDQ   240
SIEDDFSAWK ELVWPELDLL LRDEDDKAAA TPYTAAIPEY RVVFHDKPDA FSDDHTQTNG   300
HAVHDAQHPC RSNVAKKEL HTPESDRSCT HLEFDISHTG LSYETGDHVG VYCENLIEVV    360
EEAGKLLGLS TDTYFSLHID NEDGSPLGGP SLQPPFPPCT LRKALTNYAD LLSSPKKSTL   420
LALAAHASDP TEADRLRFLA SREGKDEYAE WVVANQRSLL EVMEAFPSAR PPLGVFFAAV   480
APRLQPRYYS ISSSPKMEPN RIHVTCALVY EKTPAGRIHK GICSTWMKNA VPLTESQDCS   540
WAPIFVRTSN FRLPIDPKVP VIMIGPGTGL APFRGFLQER LALKESGTEL GSSILFFGCR   600
NRKVDYIYEN ELNNFVENGA LSELDVAFSR DGPTKEYVQH KMTQKASEIW NMLSEGAYLY   660
VCGDAKGMAK DVHRTLHTIV QEQGSLDSSK AELYVKNLQM SGRYLRDVW                709
```

TABLE 19-continued

Sequences disclosed herein.

SEQ ID NO: 85
Artificial Sequence

```
atgcaatcta actccgtgaa gatttcgccg cttgatctgg taactgcgct gtttagcggc    60
aaggttttgg acacatcgaa cgcatcggaa tcgggagaat ctgctatgct gccgactata   120
gcgatgatta tggagaatcg tgagctgttg atgatactca caacgtcggt tgctgtattg   180
atcggatgcg ttgtcgtttt ggtgtggcgg agatcgtcta cgaagaagtc ggcgttggag   240
ccaccggtga ttgtggttcc gaagagagtg caagaggagg aagttgatga tggtaagaag   300
aaagttacgg ttttcttcgg cacccaaact ggaacagctg aaggcttcgc taaggcactt   360
gttgaggaag ctaaagctcg atatgaaaag gctgtcttta agtaattga tttggatgat   420
tatgctgctg atgacgatga gtatgaggag aaactaaaga aagaatcttt ggccttttc    480
tttttgcgtc cgtatggaga tggtgagcca acagataatg ctgccagatt ttataaatgg   540
tttactgagg gagatgcgaa aggagaatgg cttaataagc ttcaatatgg agtatttggt   600
ttgggtaaca gacaatatga acattttaac aagatcgcaa aagtggttga tgatggtctt   660
gtagaacagg gtgcaaagcg tcttgttcct gttggacttg gagatgatga tcaatgtatt   720
gaagatgact tcaccgcatg gaaagagtta gtatggccgg agttgatca attacttcgt    780
gatgaggatg acacaactgt tgctactcca tacacagctg ctgttgcaga atatcgcgtt   840
gttttcatg aaaaaccaga cgcgctttct gaagattata gttatacaaa tggccatgct    900
gttcatgatg ctcaacatcc atgcagatcc aacgtggctg tcaaaaagga acttcatagt   960
cctgaatctg accggtcttg cactcatctt gaatttgaca tctcgaacac cggactatca   1020
tatgaaactg gggaccatgt tggagtttac tgtgaaaact tgagtgaagt tgtgaatgat   1080
gctgaaagat tagtaggatt accaccagac acttactcct ccatccacac tgatagtgaa   1140
gacgggtcgc cacttggcgg agcctcattg ccgcctcctt cccgccatg cactttaagg    1200
aaagcattga cgtgttatgc tgatgttttg agttctccca agaagtcggc tttgcttgca   1260
ctagctgctc atgccaccga tcccagtgaa gctgatagat tgaaattcct tgcatccccc   1320
gccgaaaagg atgaatattc tcaatggata gttgcaagcc aaagaagtct ccttgaagtc   1380
atggaagcat tcccgtcagc taagccttca cttggtgttt tctttgcatc tgttgccccg   1440
cgcttacaac caagatacta ctctatttct tcctcaccca agatggcacc ggataggatt   1500
catgttacat gtgcattagt ctatgagaaa acacctgcag gccgcatcca caaaggagtt   1560
tgttcaactt ggatgaagaa cgcagtgcct atgaccgaga gtcaagattg cagttgggcc   1620
ccaatatacg tccgaacatc caatttcaga ctaccatctg accctaaggt cccggttatc   1680
atgattggac ctggcactgg tttggctcct tttagaggtt tccttcaaga gcggttagct   1740
ttaaaggaag ccggaactga cctcggttta tccattttat tcttcggatg taggaatcgc   1800
aaagtggatt tcatatatga aaacgagctt aacaactttg tggagactgg tgctcttct   1860
gagcttattg ttgctttctc ccgtgaaggc ccgactaagg aatatgtgca acacaagatg   1920
agtgagaagg cttcggatat ctggaacttg ctttctgaag gagcatattt atacgtatgt   1980
ggtgatgcca aaggcatggc caaagatgta catcgaaccc tccacacaat tgtgcaagaa   2040
cagggatctc ttgactcgtc aaaggcagaa ctctacgtga gaatctaca aatgtcagga   2100
agataccctcc gtgacgtttg gtaa                                         2124
```

SEQ ID NO: 86
Stevia rebaudiana

```
MQSNSVKISP LDLVTALFSG KVLDTSNASE SGESAMLPTI AMIMENRELL MILTTSVAVL    60
IGCVVLVWR RSSTKKSALE PPVIVVPKRV QEEEVDDGKK KVTVFFGTQT GTAEGFAKAL    120
VEEAKARYEK AVFKVIDLDD YAADDDEYEE KLKKESLAFF FLATYGDGEP TDNAARFYKW    180
FTEGDAKGEW LNKLQYGVFG LGNRQYEHFN KIAKVVDDGL VEQGAKRLVP VGLGDDDQCI    240
EDDFTAWKEL VWPELDQLLR DEDDTTVATP YTAAVAEYRV VPHEKPDALS EDYSYTNGHA    300
VHDAQHPCRS NVAVKKELHS PESDRSCTHL EFDISNTGLS YETGDHVGVY CENLSEVVND    360
AERLVGLPPD TYSSIHTDSE DGSPLGGASL PPPFPPCTLR KALTCYADVL SSPKKSALLA    420
LAAHATDPSE ADRLKFLASP AGKDEYSQWI VASQRSLLEV MEAFPSAKPS LGVFFASVAP    480
RLQPRYYSIS SSPKMAPDRI HVTCALVYEK TPAGRIHKGV CSTWMKNAVP MTESQDCSWA    540
PIYVRTSNFR LPSDPKVPVI MIGPGTGLAP FRGFLQERLA LKEAGTDLGL SILFFGCRNR    600
KVDFIYENEL NNFVETGALS ELIVAFSREG PTKEYVQHKM SEKASDIWNL LSEGAYLYVC    660
GDAKGMAKDV HRTLHTIVQE QGSLDSSKAE LYVKNLQMSG RYLRDVW                  707
```

SEQ ID NO: 87
Artificial Sequence

```
atgtcctcca actccgattt ggtcagaaga ttggaatctg ttttgggtgt ttctttcggt    60
ggttctgtta ctgattccgt tgttgttatt gctaccacct ctattgcttt ggttatcggt   120
gttttggttt tgttgtggag aagatcctct gacagatcta gagaagttaa gcaattggct   180
gttccaaagc cagttactat cgttgaagaa gaagatgaat cgaagttgc ttctggtaag    240
accagagttt ctattttcta cggtactcaa actggtactg ttgaaggttt tgctaaggct   300
ttggctgaag aaatcaaagc cagatacgaa aaagctgccg ttaaggttat tgatttggat   360
gattacacag ccgaagatga caaatacggt gaaaagttga gaaagaaac tatggccttc   420
ttcatgttgg ctacttatgg tgatggtgaa cctactgata atgctgctag attttacaag   480
tggttcaccg aaggtactga tagaggtgtt ggttgaaca atttgagata cggtgtattc   540
ggtttgggta acagacaata cgaacacttc aacaagattg ccaaggttgt tgatgattg    600
ttggttgaac aaggtgccaa gagattggtt actgttggtt gggtgatga tgatcaatgc   660
atcgaagatg atttctccgc ttggaaagaa gccttgtggc cagaattgga tcaattattg   720
caagatgata ccaacaccgt ttctactcca tacactgctg ttattccaa atacagagtt    780
gttatccacg atccatctgt tacctcttat gaagatccta actctaacat ggctaacggt   840
aatgcctctt acgatattca tcatccatgt agagctaacg ttgccgtcca aaaagaattg   900
cataagccaa atctgacag aagttgcatc catttggaat cgatatttt cgctactggt    960
tgacttactg aaaccggtga tcatgttggt gtttacgctg ataattgtga tactgta      1020
gaagaagccg ctaagttgtt gggtcaactg ttggatttgt tgttctccat tcataccgat   1080
aacaacgacg gtacttcttt gggttcttct tgccaccac catttccagg tccatgtact   1140
tgagaactg ctttggctag atatgccgat tgttgaatc caccaaaaaa ggctgctttg     1200
attgcttag ctgctcatgc tgatgaacca tctgaagctg aaagattgaa gttcttgtca    1260
tctccacaag gtaaggacga atattctaaa tgggttgtcg gttcccaaag atccttggtt   1320
```

TABLE 19-continued

Sequences disclosed herein.

```
gaagttatgg ctgaatttcc atctgctaaa ccaccattgg gtgtatttt  tgctgctgtt   1380
gttcctagat tgcaacctag atattactcc atctcttcca gtccaagatt tgctccacat   1440
agagttcatg ttacttgcgc ttttgtttat ggtccaactc caactggtag aattcacaga   1500
ggtgtatgtt cattctggat gaagaatgtt gtcccattgg aaaagtctca aaactgttct   1560
tgggccccaa ttttcatcag acaatctaat ttcaagttgc cagccgatca ttctgttcca   1620
atagttatgg ttggtccagg tactggttta gctccttta  gaggtttctt acaagaaaga   1680
ttggccttga aagaagaagg tgctcaagtt ggtcctgctc tgttgttttt tggttgcaga   1740
aacagacaaa tggacttcat ctacgaagtc gaattgaaca actttgtcga caaggtgct   1800
ttgtccgaat tgatcgttgc tttttcaaga gaaggtccat ccaaagaata cgtccaacat   1860
aagatggttg aaaaggcagc ttacatgtgg aacttgattt ctcaaggtgg ttacttctac   1920
gtttgtggtg atgctaaagg tatggctaga gatgttcata gaacattgca taccatcgtc   1980
caacaagaag aaaaggttga ttctaccaag gccgaatcca tcgttaagaa attgcaaatg   2040
gacggtagat acttgagaga tgtttggtga                                    2070
```

SEQ ID NO: 88
Rubus suavissimus
```
MSSNSDLVRR LESVLGVSFG GSVTDSVVVI ATTSIALVIG VLVLLWRRSS DRSREVKQLA    60
VPKPVTIVEE EDEFEVASGK TRVSIFYGTQ TGTAEGFAKA LAEEIKARYE KAAVKVIDLD   120
DYTAEDDKYG EKLKKETMAF FMLATYGDGE PTDNAARFYK WFTEGTDRGV WLEHLRYGVF   180
GLGNRQYEHF NKIAKVVDDL LVEQGAKRLV TVGLGDDDQC IEDDFSAWKE ALWPELDQLL   240
QDDTNTVSTP YTAVIPEYRV VIHDPSVTSY EDPYSNMANG NASYDIHHPC RANVAVQKEL   300
HKPESDRSCI HLEFDIFATG LTYETGDHVG VYADNCDDTV EEAAKLLGQP LDLLFSIHTD   360
NNDGTSLGSS LPPPPFPGPCT LRTALARYAD LLNPPKKAAL IALAAHADEP SEAERLKFLS   420
SPQGKDEYSK WVVGSQRSLV EVMAEFPSAK PPLGVFFAAV VPRLQPRYYS ISSSPRFAPH   480
RVHVTCALVY GPTPTGRIHR GVCSFWMKNV VPLEKSQNCS WAPIFIRQSN FKLPADHSVP   540
IVMVGPGTGL APFRGFLQER LALKEEGAQV GPALLFFGCR NRQMDFIYEV ELNNFVEQGA   600
LSELIVAFSR EGPSKEYVQH KMVEKAAYMW NLISQGGYFY VCGDAKGMAR DVHRTLHTIV   660
QQEEKVDSTK AESIVKKLQM DGRYLRDVW                                     689
```

SEQ ID NO: 89
Artificial Sequence
```
atgacttctg cactttatgc ctccgatctt ttcaaacaat tgaaaagtat catgggaacg    60
gattctttgt ccgatgatgt tgtattagtt attgctacaa cttctctggc actggttgct   120
ggtttcgttg tcttattgtg gaaaaagacc acggcagatc gttccggcga gctaaagcca   180
ctaatgatcc ctaagtctct gatggcgaaa gatgaggatg atgacttaga tctaggttct   240
ggaaaaacga gagtctctat cttcttcggc acacaaaccg gaacagccga aggattcgct   300
aaagcacttt cagaagagat caaagcaaga tacgaaaagg cggctgtaaa agtaatcgat   360
ttggatgatt acgctgccga tgatcaagaa tatgaggaaa agttgaaaaa ggaaacattg   420
gctttctttt gtgtagccac gtatggtgat ggtgaaccaa ccgataacgc cgcaagattc   480
tacaagtggt ttactgaaga gaacgaaaga gatatcgaat tgcagcaact tgcttacggc   540
gtttttgcct taggtaacag acaatacgag cactttaaca agataggtat tgtcttagat   600
gaagagttat gcaaaaaggg tgcgaagaga ttgattgaag tcggtttagg agatgatgat   660
caatctatcg aggatgactt taatgcatgg aaggaatctt tgtggtctga attagataag   720
ttacttaagg acgaagatga taaatccgtt gccactccat acacagccgt cattccagaa   780
tatagagtag ttactcatga tccaagattc acaacacaga aatcaatgga aagtaatgtg   840
gctaatggta atactaccat cgatattcat catccatgta gagtagacgt tgcagttcaa   900
aaggaattgc acactcatga atcagacaga tcttgcatac atcttgaatt tgatatatca   960
cgtactggta tcacttacga aacaggtgat cacgtgggtg tctacgctga aaaccatgtt  1020
gaaattgtag aggaagctgg aaagttgttg ggccatagtt tagatcttgt ttctcaatt   1080
catgccgata agaggatgg  ctcaccacta gaaagtgcag tgcctccacc atttccagga  1140
ccatgcaccc taggtaccgg tttagctcgt tacgcggatc tgttaaatcc tccacgtaaa  1200
tcagctctag tggcctttgg ctgcgtacgcc acagaaacct ctgaggcaga aaaactgaaa  1260
catctaactt caccagatgg taaggatgaa tactcacaat ggatagtagc tagtcaacgt  1320
tctttactag aagttatggc tgcttttcca tccgctaaac ctccttttggg tgttttcttc  1380
gccgcaatag cgcctagact gcaaccaaga tactattcaa tttcatcctc acctagactg  1440
gcaccatcaa gagttcatgt cacatccgct ttagtgtacg gtccaactcc tactggtaga  1500
atccataagg gcgtttgttc aacatggatg aaaaacgcgg ttccagcaga gaagtctcac  1560
gaatgttctg gtgctccaat ctttatcaga gcctccaact tcaaactgcc ttccaatcct  1620
tctactccta ttgtcatggt cggtcctggt acaggtcttg ctccattcag aggtttctta  1680
caagagaaa  tggcttaaaa ggaggatggt gaagagttgg atcttctttt gttgtttttc  1740
ggctgtagaa acagacaaat ggatttcatc tacgaagtga aactgaataa ctttgtagat  1800
caaggagtta tttcagagtt gataatggct ttttctagag aaggtgctca gaaggagtac  1860
gtccaacaca aaatgatgga aaaggccgca caagtttggg acttaatcaa agaggaaggc  1920
tatctatatg tctgtggtga tgcaaagggt atggcaagag atgttcacag aacacttcat  1980
actatagtcc aggaacagga aggcgttagt tcttctgaag cggaagcaat tgtgaaaaag  2040
ttacaaacag agggaagata cttgagagat gtgtggtaa                         2079
```

SEQ ID NO: 90
Arabidopsis thaliana
```
MTSALYASDL FKQLKSIMGT DSLSDDVVLV IATTSLALVA GFVVLLWKKT TADRSGELKP    60
LMIPKSLMAK DEDDDLDLGS GKTRVSIFFG TQTGTAEGFA KALSEEIKAR YEKAAVKVID   120
LDDYAADDDQ YEEKLKKETL AFFCVATYGD GEPTDNAARF YKWFTEENER DIKLQQLAYG   180
VPALGNRQYE HFNKIGIVLD EELCKKGAKR LIEVGLGDDD QSIEDDFNAW KESLWSELDK   240
LLKDEDDKSV ATPYTAVIPE YRVVTHDPRF TTQKSMESNV ANGNTTIDIH HPCRVDVAVQ   300
KELHTHESDR SCIHLEFDIS RTGITYETGD HVGVYAENHV EIVEEAGKLL GHSLDLVFSI   360
HADKEDGSPL ESAVPPPFPG PCTLGTGLAR YADLLNPPRK SALVALAAYA TEPSEAEKLK   420
HLTSPDGKDE YSQWIVASQR SLLEVMAAFP SAKPPLGVFF AAIAPRLQPR YYSISSSPRL   480
APSRVHVTSA LVYGPTPTGR IHKGVCSTWM KNAVPAEKSH ECSGAPIFIR ASNFKLPSNP   540
```

TABLE 19-continued

Sequences disclosed herein.

```
STPIVMVGPG TGLAPFRGFL QERMALKEDG EELGSSLLFF GCRNRQMDFI YEDELNNFVD    600
QGVISELIMA FSREGAQKEY VQHKMMEKAA QVWDLIKEEG YLYVCGDAKG MARDVHRTLH    660
TIVQEQEGVS SSEAEAIVKK LQTEGRYLRD VW                                  692
```

SEQ ID NO: 91
Artificial Sequence

```
atgtcttcct cttcctcttc cagtacctct atgattgatt tgatggctgc tattattaaa     60
ggtgaaccag ttatcgtctc cgacccagca aatgcctctg cttatgaatc agttgctgca    120
gaattgtctt caatgttgat cgaaaacaga caattcgcca tgatcgtaac tacatcaatc    180
gctgttttga tcggttgtat tgtcatgttg gtatggagaa gatccggtag tggtaattct    240
aaaagagtcg aacctttgaa accattagta attaagccaa gagaagaaga aatagatgac    300
ggtagaaaga aagttacaat attttttcggt acccaaactg gtacagctga aggttttgca    360
aaagccttag gtgaagaagc taaggcaaga tacgaaaaga ctagattcaa gatagtcgat    420
ttggatgact atgccgctga tgacgatgaa tacgaagaaa agttgaagaa agaagatgtt    480
gcattttttct ttttggcaac ctatggtgac ggtgaaccaa ctgacaatgc agccagattc    540
tacaaatggt ttacagaggg taatgatcgt ggtgaatggt tgaaaaactt aaagtacggt    600
gttttcggtt tgggtaacag acaatacgaa catttcaaca aagttgcaaa ggttgtcgac    660
gatattttgt cgaacaagg tgctcaaaga ttagtccaag taggtttggg tgacgatgac    720
caatgtatag aagatgactt tactgcctgg agagaagctt tgtggcctga attagacaca    780
atcttgagag aagaaggtga caccgccgtt gctaccccat atactgctgc agtattagaa    840
tacagagttt ccatccatga tagtgaagac gcaaagttta atgatatcac tttggccaat    900
ggtaacggtt atacagtttt cgatgcacaa caccccttaca aagctaacgt tgcagtcaag    960
agagaattac ataccagaa atccgacaga agttgtatac agttggaatt tgatatcgtt   1020
ggttccggtt taaccatgaa gttgggtgac catgtaggtg tttttatgcga caatttgtct   1080
gaaactgttg atgaagcatt gagattgttg gatatgtccc ctgacactta ttttagtttg   1140
cacgctgaaa aagaagatgg tacaccaatt tccagttctt taccacctcc attccctcca   1200
tgtaacttaa gaacagctct gaccagatac gcttgcttgt tatcatcccc taaaaagtcc   1260
gccttggttg cttttagccgc tcatgctagt gatcctactg aagcagaaag attgaaacac   1320
ttagcatctc cagccggtaa agatgaatat tcaaagtggg tagttgaatc tcaaagatca   1380
ttgttagaag ttatggcaga atttccatct gccaagcctc cattaggtgt cttctttgct   1440
ggtgtagcac ctagattgca accaagattc tactcaatca gttcttcacc taagatcgct   1500
gaaactagaa ttcatgttac atgtgcatta gtctacgaaa agatgccaac cggtagaatt   1560
cacaagggtg tatgctctac ttggatgaaa aatgctgttc cttacgaaaa atcagaaaag   1620
ttgttcttag gtagaccaat cttcgtaaga caatcaaact tcaagttgcc ttctgattca   1680
aaggttccaa taatcatgat aggtcctggt acaggtttag ccccattcag aggtttcttg   1740
caagaaagat tggctttagt tgaatctggt gtcgaattag gtccttcagt tttgttcttt   1800
ggttgtagaa acagaagaat ggatttcatc tatgaagaag aattgcaaag attcgtcgaa   1860
tctggtgcat tggccgaatt atctgtagct ttttcaagag aaggtccaac taaggaatac   1920
gttcaacata agatgatgga taaggcatcc gacatatgga acatgatcag tcaaggtgct   1980
tatttgtacg tttgcggtga cgcaaagggt atggccagag atgtccatag atctttgcac   2040
acaattgctc aagaacaagg ttccatggat agtaccaaag ctgaaggttt cgtaaagaac   2100
ttacaaactt ccggtagata cttgagagat gtctggtga                           2139
```

SEQ ID NO: 92
Arabidopsis thaliana

```
MSSSSSSSTS MIDLMAAIIK GEPVIVSDPA NASAYESVAA ELSSMLIENR QFAMIVTTSI     60
AVLIGCIVML VWRRSGSGNS KRVEPLKPLV IKPREEEIDD GRKKVTIFFG TQTGTAEGFA    120
KALGEEAKAR YEKTRFKIVD LDDYAADDDE YEEKLKKEDV AFFFLATYGD GEPTDNAARF    180
YKWFTEGNDR GEWLKNLKYG VFGLGNRQYE HFNKVAKVVD DILVEQGAQR LVQVGLGDDD    240
QCIEDDFTAW REALWPELDT ILREEGDTAV ATPYTAAVLE YRVSIHDSED AKFNDITLAN    300
GNGYTVFDAQ HPYKANVAVK RELHTPESDR SCIHLEFDIA GSGLTMKLGD HVGVLCDNLS    360
ETVDEALRLL DMSPDTYFSL HAEKEDGTPI SSSLPPPFPP CNLRTALTRY ACLLSSPKKS    420
ALVALAAHAS DPTEAERLKH LASPAGKDEY SKWVVESQRS LLEVMAEFPS AKPPLGVFFA    480
GVAPRLQPRF YSISSSPKIA ETRIHVTCAL VYEKMPTGRI HKGVCSTWMK NAVPYEKSEK    540
LFLGRPIFVR QSNFKLPSDS KVPIIMIGPG TGLAPFRGFL QERLALVESG VELGPSVLFF    600
GCRNRRMDFI YEEELQRFVE SGALAELSVA FSREGPTKEY VQHKMMDKAS DIWNMISQGA    660
YLYVCGDAKG MARDVHRSLH TIAQEQGSMD STKAEGFVKN LQTSGRYLRD VW            712
```

SEQ ID NO: 93
Artificial Sequence

```
atggaagcct cttacctata catttctatt ttgcttttac tggcatcata cctgttcacc     60
actcaactta gaaggaagag cgctaatcta ccaccaaccg tgtttccatc aataccaatc    120
attggacact tatacttact caaaaagcct ctttatagaa cttagcaaa aattgccgct    180
aagtacggac caatactgca attacaactc ggctacagac gtgttctggt gatttcctca    240
ccatcagcag cagaagagtg cttttaccaat aacgatgtaa tcttcgcaaa tagacctaag    300
acattgtttg gcaaaatagt gggtggaaca tcccttggca gtttatccta cggcgatcaa    360
tggcgtaatc taaggagagt agcttctatc gaaatcctat cagttcatag gttgaacgaa    420
tttcatgata tcagagtgga tgagaacaga ttgttaatta gaaaacttag aagttcatct    480
tctcctgtta ctcttataac agtctttat gctctaacat tgaacgtcat tatgagaatg    540
atctctggca aaagatattt cgacagtggg gatagaaat tggaggagga aggtaagaga    600
tttcgagaaa tcttagacga aacgttgctt ctagccggtg cttctaatgt tggcgactac    660
ttaccaatat tgaactggtt gggagttaag tctcttgaaa gaaattgat cgctttgcag    720
aaaagagatg atcttttttct ccaggggtttg attgaacagg ttagaaaatt tggtggtcgt    780
aaagtaggca aaggtagaaa aacgttagatc gaactcttat tatctttgca agagtcagaa    840
cctgagtact atacagatgc tatgataaga tcttttgtcc taggtctgct ggctgcaggt    900
agtgatactt cagcgggcac tatgaatgg gccatgagct actggtcaa tcacccacat    960
gtattgaaga aagctcaagc tgaaatcgat agagttatcg taataacag attgattgac   1020
gagtcagaca ttgaaaatat ccctttacatc gggtgtatta tcaatgaaac tctaagactc   1080
```

TABLE 19-continued

Sequences disclosed herein.

```
tatccagcag ggccattgtt gttcccacat gaaagttctg ccgactgcgt tatttccggt    1140
tacaatatac ctagaggtac aatgttaatc gtaaaccaat gggcgattca tcacgatcct    1200
aaagtctggg atgatcctga aaccttaaa cctgaaagat ttcaaggatt agaaggaact     1260
agagatggtt tcaaacttat gccattcggt tctgggagaa gaggatgtcc aggtgaaggt    1320
ttggcaataa ggctgttagg gatgacacta ggctcagtga tccaatgttt tgattgggag    1380
agagtaggag atgagatggt tgacatgaca gaaggtttgg gtgtcacact tcctaaggcc    1440
gttccattag ttgccaaatg taagccacgt tccgaaatga ctaatctcct atccgaactt    1500
taa                                                                   1503
```

SEQ ID NO: 94
Stevia rebaudiana

```
MEASYLYISI LLLLASYLFT TQLRRKSANL PPTVFPSIPI IGHLYLLKKP LYRTLAKIAA      60
KYGPILQLQL GYRRVLVISS PSAAEECFTN NDVIFANRPK TLFGKIVGGT SLGSLSYGDQ     120
WRNLRRVASI EILSVHRLNE FHDIRVDENR LLIRKLRSSS SPVTLITVFY ALTLNVIMRM     180
ISGKRYFDSG DRELEEEGKR FREILDETLL LAGASNVGDY LPILNWLGVK SLEKKLIALQ     240
KKRDDFFQGL IEQVRKSRGA KVGKGRKTMI ELLLSLQESE PEYYTDAMIR SFVLGLLAAG     300
SDTSAGTMEW AMSLLVNHPH VLKKAQAEID RVIGNNRLID ESDIGNIPYI GCIINETLRL    360
YPAGPLLFPH ESSADCVISG YNIPRGTMLI VNQWAIHHDP KVWDDPETFK PERFQGLEGT    420
RDGFKLMPFG SGRRGCPGEG LAIRLLGMTL GSVIQCFDWE RVGDEMVDMT EGLGVTLPKA    480
VPLVAKCKPR SEMTNLLSEL                                                 500
```

SEQ ID NO: 95
Rubus suavissimus

```
atggaagtaa cagtagctag tagtgtagcc ctgagcctgg tctttattag catagtagta     60
agatgggcat ggagtgtggt gaattgggtg tggtttaagc cgaagaagct ggaaagattt    120
ttgagggagc aaggccttaa aggcaattcc tacaggtttt tatatggaga catgaaggag    180
aactctatcc tgctcaaaca agcaagatcc aaacccatga acctctccac ctcccatgac   240
atagcacctc aagtcacccc ttttgtcgac caaaccgtga agcttacgg taagaactct    300
tttaattggg ttggccccat accaaggggtg aacataatga atccagaaga tttgaaggac  360
gtcttaacaa aaaatgttga ctttgttaag ccaatatcaa acccacttat caagttgcta   420
gctacaggta ttgcaatcta tgaaggtgag aaatggacta aacacagaag gattatcaac   480
ccaacattcc attcggagag gctaaagcgt atgttacctt cattcacca aagttgtaat   540
gagatggtca aggaatggga gagcttggtg tcaaaagagg gttcatcatg tgagttggat   600
gtctggcctt tccttgaaaa tatgtcggca gatgtgatct cgagaacagc atttggaact   660
agctacaaaa aaggacagaa aatctttgaa ctcttgagag agcaagtaat atatgtaacg   720
aaaggctttc aaagttttta cattccagga tggaggtttc tcccaactaa gatgaacaag  780
aggatgaatg agattaacga agaaataaaa ggattaatca ggggtattat aattgacaga  840
gagcaaatca ttaaggcagg tgaagaaacc aacgatgact tattaggtgc acttatggag  900
tcaaacttga aggacattcg ggaacatggg aaaaacaaca aaaatgttgg gatgagtatt   960
gaagatgtaa ttcaggagtg taagctgttt tactttgctg ggcaagaaac cacttcagtg  1020
ttgctggctt ggacaatggt tttacttggt caaaatcaga actggcaaga tcgagcaaga  1080
caagaggttt tgcaagtctt tggaagcagc aagccagatt ttgatggtct agctcacctt  1140
aaagtcgtaa ccatgatttt gcttgaagtt cttcgattat acccaccagt cattgaactt  1200
attcgaacca ttcacaagaa aacaacaactt gggaagctct cactaccaga aggagttgaa  1260
gtccgcttac caacactgct cattcaccat gacaaggaac tgtgggggtga tgatgcaaac  1320
cagttcaatc cagagaggtt tcggaagga gtttccaaag caacaaagaa ccgactctca  1380
ttcttcccct tcggagccgg tccacgcatt tgcattggac agaactttc tatgatgaa    1440
gcaaagttgg ccttagcatt gatcttgcaa cacttcacct ttgagctttc tccatctcat  1500
gcacatgctc cttcccatcg tataaacctt caaccacagt atggtgttcg tatcatttta  1560
catcgacgtt ag                                                        1572
```

SEQ ID NO: 96
Artificial Sequence

```
atggaagtca ctgtcgcctc ttctgtcgct ttatccttag tcttcatttc cattgtcgtc     60
agatgggctt ggtccgttgt caactgggtt tggttcaaac caagaagtt ggaaagattc     120
ttgagagagc aaggtttgaa gggtaattct tatagattct tgtacggtga catgaaggaa   180
aattctattt tgttgaagca agccagatcc aaaccaatga acttgtctac ctctcatgat   240
attgctccac aagttactcc attcgtcgat caaactgtta agcctacgg taagaactct    300
ttcaattggg ttggtccaat tcctagagtt aacatcatga acccagaaga tttgaaggat  360
gtcttgacca agaacgttga cttcgttaag ccaatttcca acccattgat taaattgttg   420
gctactggta ttgccattta cgaaggtgaa aagtggacta agcatagaag aatcatcaac   480
cctaccttcc actctgaaag attgaagaga atgttaccat cttttccatca atcctgtaat  540
gaaatggtta aggaatggga atccttggtt tctaaagaag gttcttctg cgaattggat   600
gtttggccat tcttggaaaa tatgtctgct gatgtcattt ccagaaccgc tttcggtacc  660
tcctacaaga agggtcaaaa gatttttgaa ctgttgaga gcaagttat ttacgttacc    720
aagggtttcc aatccttcta catcccaggt tggagattct tgccaactaa atgaacaag   780
cgtatgaacg agatcaacga agaaattaaa ggttttgatca gaggtattat tatcgacaga  840
gaacaaatta ttaaagctgg tgaagaaacc aacgatgatt tgttgggtgc tttgatggaa  900
tccaacttga aggatattag agaacatggt aagaacaaca agatgttgg tatgtctatt    960
gaagatgtta ttcaagaatg taagttattc tacttcgctg tcaagagac cacttctgtt  1020
ttgttagcct ggactatggt ccttgttaggt caaaaccaaa attggcaaga tagactaga   1080
caagaagttt tgcaagtctt cggttcttcc aagccagact tgatggttt ggcccacttg  1140
aagttgtta ctatgatttt gttagaagtt acccaccagt cattgagtta                1200
atcagaacca ttcataaaaa gactcaattg gtaaattat ctttgccaga aggtgttgaa   1260
gtcagattac caacctgtt gattcaccac gataaggaat tatgggggtga cgacgctaat  1320
caatttaatc cagaaagatt ttccgaaggt gtttccaagg ctaccaaaaa ccgtttgtcc  1380
ttcttcccat tggtgctgg tccacgtatt tgtatcggtc aaaactttc catgatgaa    1440
gccaagttgg cttttggcttt aatcttgcaa cacttcactt tcgaattgtc tccatccat  1500
```

TABLE 19-continued

Sequences disclosed herein.

```
gcccacgctc cttctcatag aatcacttta caaccacaat acggtgtcag aatcatctta   1560
cacagaagat aa                                                       1572

SEQ ID NO: 97
Rubus suavissimus
MEVTVASSVA LSLVFISIVV RWAWSVVNWV WFKPKKLERF LREQGLKGNS YRFLYGDMKE     60
NSILLKQARS KPMNLSTSHD IAPQVTPFVD QTVKAYGKNS FNWVGPIPRV NIMNPEDLKD    120
VLTKNVDFVK PISNPLIKLL ATGIAIYEGE KWTKHRRIIN PTFHSERLKR MLPSFHQSCN    180
EMVKEWESLV SKEGSSCELD VWPFLENMSA DVISRTAFGT SYKKGQKIFE LLREQVIYVT    240
KGFQSFYIPG WRFLPTKMNK RMNEINEEIK GLIRGIIIDR EQIIKAGEET NDDLLGALME    300
SNLKDIREHG KNNKNVGMSI EDVIQECKLF YFAGQETTSV LLAWTMVLLG QNQNWQDRAR    360
QEVLQVFGSS KPDFDGLAHL KVVTMILLEV LRLYPPVIEL IRTIHKKTQL GKLSLPEGVE    420
VRLPTLLIHH DKELWGDDAN QFNPERFSEG VSKATKNRLS FFPFGAGPRI CIGQNFSMME    480
AKLALALILQ HFTFELSPSH AHAPSHRITL QPQYGVRIIL HRR                      523

SEQ ID NO: 98
Prunus avium
atggaagcat caagggctag ttgtgttgcg ctatgtgttg tttgggtgag catagtaatt     60
acattggcat ggagggtgct gaattgggtg tggttgaggc caaagaaact agaaagatgc    120
ttgagggagc aaggccttac aggcaattct tacaggcttt tgtttggaga caccaaggat    180
ctctcgaaga tgctggaaca aacacaatcc aaacccatca aactctccac ctcccatgat    240
atagcgccac gagtcacccc attttccat cgaactgtga actctaatgg caagaattct     300
tttgttttgga tgggccctat accaagagtg cacatcatga atccagaaga tttgaaagat    360
gccttcaaca gacatgatga ttttcataag acagtaaaaa atcctatcat gaagtctcca    420
ccaccgggca ttgtaggcat tgaaggtgag caatgggcta aacacagaaa gattatcaac    480
ccagcattcc atttagagaa gctaaagggt atggtaccaa tatttacca aagttgtagc      540
gagatgatta acaaatggga gagcttggtg tccaaagaga gttcatgtga gttggatgtg    600
tggccttatc ttgaaaattt taccagcgat gtgatttccc gagctgcatt tggaagtagc    660
tatgaagagg gaaggaaaat atttcaacta ctaagagagg aagcaaaagt ttattcggta    720
gctctacgaa gtgtttacat tccaggatgg aggtttctac caaccaagca gaacaagaag    780
acgaaggaaa ttcacaatga aattaaaggc ttacttaagg gcattataaa taaaagggaa    840
gaggcgatga aggcagggga agccactaaa gatgacttac taggaaatact tatggagtcc    900
aacttcaggg aaattcagga acatgggaac aacaaaaatg ctggaatgag tattgaagat    960
gtaattggag agtgtaagtt gttttacttt gctgggcaag agaccacttc ggtgttgctt   1020
gtttggacaa tgattttact aagccaaaat caggattggc aagctcgtgc aagagaagag   1080
gtcttgaaag tctttggaag caacatccca acctatgaag agctaagtca cctaaaagtt   1140
gtgaccatga ttttacttga agttcttcga ttatacccat cagtcgttgc gcttcctcga   1200
accactcaca agaaaacaca gcttggaaaa ttatcattac cagctggagt ggaagtctcc   1260
ttgcccatac tgcttgttca ccatgacaaa gagttgtggg gtgaggatgc aaatgagttc   1320
aagccagaga ggttttcaga gggagtttca aaggcaacaa gaacaaatt tacatactta   1380
cctttcggag gggtccaag gatttgcatt ggacaaaact ttgccatggt ggaagctaaa    1440
ttggccttgg ccctgatttt acaacacttt gcctttgagc tttctccatc ctatgctcat    1500
gctccttctg cagttataac ccttcaacct caatttggtg ctcatatcat tttgcataaa   1560
cgttga                                                              1566

SEQ ID NO: 99
Artificial Sequence
atggaagctt ctagagcatc ttgtgttgct ttgtgtgttg tttgggtttc catcgttatt     60
actttggctt ggagagtttt gaattgggtc tggttaagac caaaaaaagtt ggaaagatgc   120
ttgagagaac aaggtttgac tggtaactct tacagattgt tgttcggtga taccaaggac    180
ttgtctaaga tgttggaaca aactcaatcc aagcctatca agttgtctac ctctcatgat    240
attgctccaa gagttactcc attcttccat agaactgtta actccaacgg taagaactct    300
tttgtttgga tgggtccaat tccaagagtc catattatga acctgaaga tttgaaggac    360
gctttcaaca gacatgatga tttccataag accgtcaaga acccaattat gaagtctcca    420
ccaccaggta tagttggtat tgaaggtgaa caatgggcca acatagaaa gattattaac    480
ccagccttcc acttggaaaa gttgaaaggt atggttccaa tcttctacca atcctgctct    540
gaaatgatta caagtggga atccttggtt tccaaagaat cttcctgtga attggatgtc    600
tggccatatt tggaaaactt cacctccgat gttatttcca gagctgcttt tggttcttct    660
tacgaagaag gtagaaagat cttccaatta ttgagagaag aagccaaggt ttactccgtt    720
gctttgagat ctgtttacat tccaggttgg agattcttgc caactaagca aaacaaaaag    780
accaaagaaa tccacaacga aatcaagggt ttgttaaagg gtatcatcaa caagagagaa    840
gaagctatga aggctggtga agctacaaaa gatgatttgt tgggtatctt gatggaatcc    900
aacttcagag aaatccaaga aacggtaac aacaagaatg ccggtatgtc tattgaagat    960
gttatcggtg aatgcaagtt gttctacttt gctggtcaag aaactacctc cgttttgttg   1020
gtttggacca tgatttttgtt gtcccaaaat caagattggc aagctagagc tagaagaagaa   1080
gtcttgaaag ttttcggttc taacatccca acctacgaag aattgtctca cttgaaggtt   1140
gtcactatga tcttgttgga agtattgaga ttatacccat ccgttgttgc attgccaaga   1200
actactcata gaaaaactca attgggtaaa ttgtccttgc cagctggtgt tgaagtttct   1260
ttgccattac tgttagtcca ccacgacaaa gaattgtggg gtgaagatgc taatgaattc   1320
aagccagaaa gattctccga aggtgtttct aaagctacca gaacaagtt cacttacttg   1380
ccatttggtg gtggtccaag aatatgtatt ggtcaaaatt tcgctatggt cgaagctaaa   1440
ttggctttgg ctttgatctt gcaacatttc gctttcgaat tgtcaccatc ttatgctcat   1500
gctccatctg ctgttattac attgcaacca caatttggtg cccatatcat cttgcataag   1560
agataac                                                             1567
```

TABLE 19-continued

Sequences disclosed herein.

```
SEQ ID NO: 100
Prunus avium
MEASRASCVA LCVVWVSIVI TLAWRVLNWV WLRPKKLERC LREQGLTGNS YRLLFGDTKD    60
LSKMLEQTQS KPIKLSTSHD IAPRVTPFFH RTVNSNGKNS FVWMGPIPRV HIMNPEDLKD   120
AFNRHDDFHK TVKNPIMKSP PPGIVGIEGE QWAKHRKIIN PAFHLEKLKG MVPIFYQSCS   180
EMINKWESLV SKESSCELDV WPYLENFTSD VISRAAFGSS YEEGRKIFQL LREEAKVYSV   240
ALRSVYIPGW RFLPTKQNKK TKEIHNEIKG LLKGIINKRE EAMKAGEATK DDLLGILMES   300
NFREIQEHGN NKNAGMSIED VIGECKLFYF AGQETTSVLL VWTMILLSQN QDWQARAREE   360
VLKVFGSNIP TYEELSHLKV VTMILLEVLR LYPSVVALPR TTHKKTQLGK LSLPAGVEVS   420
LPILLVHHDK ELWGEDANEF KPERFSEGVS KATKNKFTYL PFGGGPRICI GQNFAMVEAK   480
LALALILQHF AFELSPSYAH APSAVITLQP QFGAHIILHK R                      521

SEQ ID NO: 101
Prunus mume
ASWVAVLSVV WVSMVIAWAW RVLNWVWLRP KKLEKCLREQ GLAGNSYRLL FGDTKDLSKM    60
LEQTQSKPIK LSTSHDIAPH VTPFFHQTVN SYGKNSFVWM GPIPRVHIMN PEDLKDTFNR   120
HDDFHKVVKN PIMKSLPQGI VGIEGEQWAK HRKIINPAFH LEKLKGMVPI FYRSCSEMIN   180
KWESLVSKES SCELDVWPYL ENFTSDVISR AAFGSSYEEG RKIFQLLREE AKIYTVAMRS   240
VYIPGWRFLP TKQNKKAKEI HNEIKGLLKG IINKREEAMK AGEATKDDLL GILMESNFRE   300
IQEHGNNKNA GMSIEDVIGE CKLFYFAGQE TTSVLLVWTM VLLSQNQDWQ ARAREEVLQV   360
FGSNIPTYEE LSQLKVVTMI LLEVLRLYPS VVALPRTTHK KTQLGKLSLP AGVEVSLPIL   420
LVHHDKELWG EDANEFKPER FSEGVSKATK NQFTYFPFGG GPRICIGQNF AMMEAKLALS   480
LILRHFALEL SPLYAHAPSV TITLQPQYGA HIILHKR                           517

SEQ ID NO: 102
Prunus mume
MEASRPSCVA LSVVLVSIVI AWAWRVLNWV WLRPNKLERC LREQGLTGNS YRLLFGDTKE    60
ISMMVEQAQS KPIKLSTTHD IAPRVIPFSH QIVYTYGRNS FVWMGPTPRV TIMNPEDLKD   120
AFNKSDEFQR AISNPIVKSI SQGLSSLEGE KWAKHRKIIN PAFHLEKLKG MLPTFYQSCS   180
EMINKWESLV FKEGSREMDV WPYLENLTSD VISRAAFGSS YEEGRKIFQL LREEAKFYTI   240
AARSVYIPGW RFLPTKQNKR MKEIHKEVRG LLKGIINKRE DAIKAGEAAK GNLLGILMES   300
NFREIQEHGN NKNAGMSIED VIGECKLFYF AGQETTSVLL VWTLVLLSQN QDWQARAREE   360
VLQVFGTNIP TYDQLSHLKV VTMILLEVLR LYPAVVELPR TTYKKTQLGK FLLPAGVEVS   420
LHIMLAHHDK ELWGEDAKEF KPERFSEGVS KATKNQFTYF PFGAGPRICI GQNFAMLEAK   480
LALSLILQHF TFELSPSYAH APSVTITLHP QFGAHFILHK R                      521

SEQ ID NO: 103
Prunus mume
CVALSVVLVS IVIAWAWRVL NWVWLRPNKL ERCLREQGLT GNSYRLLFGD TKEISMMVEQ    60
AQSKPIKLST THDIAPRVIP FSHQIVYTYG RNSFVWMGPT PRVTIMNPED LKDAFNKSDE   120
FQRAISNPIV KSISQGLSSL EGEKWAKHRK IINPAFHLEK LKGMLPTFYQ SCSEMINKWE   180
SLVFKEGSRE MDVWPYLENL TSDVISRAAF GSSYEEGRKI FQLLREEAKF YTIAARSVYI   240
PGWRFLPTKQ NKRMKEIHKE VRGLLKGIIN KREDAIKAGE AAKGNLLGIL MESNFREIQE   300
HGNNKNAGMS IEDVIGECKL FYFAGQETTS VLLVWTLVLL SQNQDWQARA REEVLQVFGT   360
NIPTYDQLSH LKVVTMILLE VLRLYPAVVE LPRTTYKKTQ LGKFLLPAGV EVSLHIMLAH   420
HDKELWGEDA KEFKPERFSE GVSKATKNQF TYFPFGAGPR ICIGQNFAML EAKLALSLIL   480
QHFTFELSPS YAHAPSVTIT LHPQFGAHFI LHKR                              514

SEQ ID NO: 104
Prunus persica
MGPIPRVHIM NPEDLKDTFN RHDDFHKVVK NPIMKSLPQG IVGIEGDQWA KHRKIINPAF    60
HLEKLKGMVP IFYQSCSEMI NIWKSLVSKE SSCELDVWPY LENFTSDVIS RAAFGSSYEE   120
GRKIFQLLRE EAKVYTVAVR SVYIPGWRFL PTKQNKKTKE IHNEIKGLLK GIINKREEAM   180
KAGEATKDDL LGILMESNFR EIQEHGNNKN AGMSIEDVIG ECKLFYFAGQ ETTSVLLVWT   240
MVLLSQNQDW QARAREEVLQ VFGSNIPTYE ELSHLKVVTM ILLEVLRLYP SVVALPRTTH   300
KKTQLGKLSL PAGVEVSLPI LLVHHDKELW GEDANEFKPE RFSEGVSKAT KNQFTYPPFG   360
GGPRICIGQN FAMMEAKLAL SLILQHFTFE LSPQYSHAPS VTITLQPQYG AHLILHKR    418

SEQ ID NO: 105
Artificial Sequence
atgggtttgt tcccattaga ggattcctac gcgctggtct ttgaaggact agcaataaca    60
ctggctttgt actatctact gtctttcatc tacaaaacat ctaaaaagac atgtacacct   120
cctaaagcat ctggtgaaat cattccaatt acaggaatca tattgaatct gctatctggc   180
tcaagtggtc tacctattat cttagcactt gcctctttag cagacagatg tggtcctatt   240
ttcaccatta ggctgggtat taggagagtg ctagtagtag caaattggga aatcgctaag   300
gagattttca ctaccacga tttgatagtt tctaatagac caaaatactt agccgctaag   360
attcttggtt tcaattatgt ttcattctct ttcgctccat acggcccata ttgggtcgga   420
atcagaaaga ttattgctac aaaactaatg tcttcttcca gacttcagaa gttgcaattt   480
gtaagagttt ttgaactaga aaactctatg aaatctatca gagaatcatg gaaggagaaa   540
aaggatgaag agggaaaggt attagttgag atgaaaaagt ggttctggga actgaatatg   600
aacatagtgt taaggacagt tgctggtaaa caatacactg gtacagttga tgatgccgat   660
gcaaagcgta tctccgagtt attcagaaa tggtttcact acactggcag atttgtcgtt   720
ggagacgctt ttccttttct aggttggttg gacctgggcg gatacaaaaa gacaatggaa   780
ttagttgcta gtagattgga ttccaatggtc agtaaatgat tagatgagca tcgtaaaaag   840
caagctaacg atgacaaaaa ggaggatatg gatttcatgg atatcatgat ctccatgaca   900
gaagcaaatt caccacttga aggatacggg actgatacta ttatcaagac acatgtatg    960
actttgattg tttcaggagt tgatacaacc tcaatcgtac ttacttgggc cttatcactt  1020
ttgttaaaca acagagatac tttgaaaaag gcacaagagg aattagatat gtgcgtaggt  1080
```

TABLE 19-continued

Sequences disclosed herein.

```
aaaggaagac aagtcaacga gtctgatctt gttaacttga tatacttgga agcagtgctt   1140
aaagaggctt taagacttta cccagcagcg ttcttaggcg gaccaagagc attcttggaa   1200
gattgtactg ttgctggtta tagaattcca aagggcacct gcttgttgat taacatgtgg   1260
aaactgcata gagatccaaa catttggagt gatccttgcg aattcaagcc agaaagattt   1320
ttgacaccta atcaaaagga tgttgatgtg atcggtatgg atttcgaatt gataccattt   1380
ggtgccggca gaagatattg tccaggtact agattggctt tacagatgtt gcatatcgta   1440
ttagcgacat tgctgcaaaa cttcgaaatg tcaacaccaa acgatgcgcc agtcgatatg   1500
actgcttctg ttggcatgac aaatgccaaa gcatcacctt tagaagtctt gctatcacct   1560
cgtgttaaat ggtcctaa                                                 1578

SEQ ID NO: 106
Stevia rebaudiana
MGLFPLEDSY ALVFEGLAIT LALYYLLSFI YKTSKKTCTP PKASGEHPIT GHLNLLSGSS    60
GLPHLALASL ADRCGPIFTI RLGIRRVLVV SNWEIAKEIF TTHDLIVSNR PKYLAAKILG   120
FNYVSFSFAP YGPYWVGIRK IIATKLMSSS RLQKLQFVRV FELENSMKSI RESWKEKKDE   180
EGKVLVEMKK WFWELNMNIV LRTVAGKQYT GTVDDADAKR ISELFREWFH YTGRFVVGDA   240
FPPFLGWLDLG GYKKTMELVA SRLDSMVSKW LDEHRKKQAN DDKKEDMDFM DIMISMTEAN   300
SPLEGYGTDT IIKTTCMTLI VSGVDTTSIV LTWALSLLLN NRDTLKKAQE ELDMCVGKGR   360
QVNESDLVNL IYLEAVLKEA LRLYPAAFLG GPRAFLEDCT VAGYRIPKGT CLLINMWKLH   420
RDPNIWSDPC EFKPERFLTP NQKDVDVIGM DFELIPFGAG RRYCPGTRLA LQMLHIVLAT   480
LLQNFEMSTP NDAPVDMTAS VGMTNAKASP LEVLLSPRVK WS                      522

SEQ ID NO: 107
Artificial Sequence
atgatacaag ttttaactcc aattctactc ttcctcatct tcttcgtttt ctggaaagtc    60
tacaaacatc aaaagactaa aatcaatcta ccaccaggtt ccttcggctg gccattttg   120
ggtgaaacct tagccttact tagagcaggc tgggattctg agccagaaga attcgtaaga   180
gagcgtatca aaaagcatgg atctccactt gttttcaaga catcactatt tggagacaga   240
ttcgctgttc tttgcggtcc agctggtaat aagtttttgt tctgcaacga aaacaaatta   300
gtggcatctt ggtggccagt ccctgtaagg aagttgttcg gtaaaagttt actcacaata   360
agaggagatg aagcaaaatg gatgagaaaa atgctattgt cttacttggg tccagatgca   420
tttgccacac attatgccgt tactatggat gttgtaacac gtagacatat tgatgtccat   480
tggaggggca aggaggaagt taatgtattt caaacagtta agttgtacgc attcgaatta   540
gcttgtagat tattcatgaa cctagatgac ccaaaccaca tcgcgaaact cggtagtctt   600
ttcaacattt tcctcaaagg gatcatcgag cttcctatag acgttcctgg aactagattt   660
tactccagta aaaaggccgc agctgccatt agaattgaat tgaaaaagct cattaaagct   720
agaaaactcg aattgaagga gggtaaggcg tcttcttcac aggacttgct ttctcatcta   780
ttaacatcac ctgatgagaa tgggatgttc ttgacagaag aggaaatagt cgataacatt   840
ctacttttgt tattcgctgg tcacgatacc tctgcactat caataacact tttgatgaaa   900
accttaggtg aacacagtga tgtgtacgac aaggttttga ggaacaatt agaaatttcc   960
aaaacaaagg aggcttggga atcactaaag tgggaagata tccagaagat gaagtactca   1020
tggtcagtaa tctgtgaagt catgagattg aatcctcctg tcataggac atacagagag   1080
gcgttggttg atatcgacta tgctggttac actatcccaa aggatggaa gttgcattgg   1140
tcagctgttt ctactcaaag agacgaagcc aatttcgaag atgtaactag attcgatcca   1200
tccagatttg aaggggcagg ccctactcca ttcacatttg tgcctttcgg tggaggtcct   1260
agaatgtgtt taggcaaaga gtttgccagg ttagaagtgt tagcatttct ccacaacatt   1320
gttaccaact ttaagtggga tcttctaatc cctgatgaga agatcgaata tgatccaatg   1380
gctactccag ctaagggctt gccaattaga cttcatccac accaagtcta a            1431

SEQ ID NO: 108
Stevia rebaudiana
MIQVLTPILL FLIFFVFWKV YKHQKTKINL PPGSFGWPFL GETLALLRAG WDSEPERFVR    60
ERIKKHGSPL VFKTSLFGDR FAVLCGPAGN KFLFCNENKL VASWWPVPVR KLFGKSLLTI   120
RGDEAKWMRK MLLSYLGPDA FATHYAVTMD VVTRRHIDVH WRGKEEVNVF QTVKLYAFEL   180
ACRLFMNLDD PNHIAKLGSL FNIFLKGIIE LPIDVPGTRF YSSKKAAAAI RIELKKLIKA   240
RKLELKEGKA SSSQDLLSHL LTSPDENGMF LTEEEIVDNI LLLLFAGHDT SALSITLLMK   300
TLGEHSDVYD KVLKEQLEIS KTKEAWESLK WEDIQKMKYS WSVICEVMRL NPPVIGTYRE   360
ALVDIDYAGY TIPKGWKLHW SAVSTQRDEA NFEDVTRFDP SRFEGAGPTP FTFVPFGGGP   420
RMCLGKEFAR LEVLAFLHNI VTNFKWDLLI PDEKIEYDPM ATPAKGLPIR LHPHQV        476

SEQ ID NO: 109
Artificial Sequence
atggagtctt tagtggttca tacagtaaat gctatctggt gtattgtaat cgtcgggatt    60
ttctcagttg gttatcacgt ttacggtaga gctgtggtcg aacaatggag aatgagaaga   120
tcactgaagc tacaaggtgt taaaggccca ccaccatcca tcttcaatgg taacgtctca   180
gaaatgcaac gtatccaatc cgaagctaaa cactgtctg gcgataacat tatctccact   240
gattattctt cttcattatt cccacacttc gatcactgga gaaaacagta cggcagaatc   300
tacacatact ctactggatt aaagcaacac ttgtacatca atcatccaga aatggtgaag   360
gagctatctc agactaacac attgaacttg gtagaatca cccatataac caaagattg    420
aatcctatct taggtaacgg aatcataacc tctaatggtc ctcattggc ccatcagcgt   480
agaattatcg cctacgagtt tactcatgat aagatcaagg gtatggttgg tttgatggtt   540
gagtctgcta tgcctatgtt gaataagtgg gaggagatgg taaagagagg cggagaaatg   600
ggatgcgaca taagagttga tgaggacttg aaagatgtat cagcagatgt gattgcaaaa   660
gcctgtttcg gatcctcatt ttctaaaggt aaggctattt tctctatgat aagagatttg   720
cttacagcta tcacaaagag aagtgttcta ttcagattca acggattcac tgatatggtc   780
tttgggagta aaaagcatgg tgacgttgat atagacgctt tagaaatgga attggaatca   840
tccatttggg aaactgtcaa ggaacgtgaa atagaatgta agatactca caaaaaggat   900
ctgatgcaat tgattttgga aggggcaatg cgttcatgtg acggtaacct ttgggataaa   960
```

TABLE 19-continued

Sequences disclosed herein.

```
tcagcatata gaagatttgt tgtagataat tgtaaatcta tctacttcgc agggcatgat   1020
agtacagctg tctcagtgtc atggtgtttg atgttactgg ccctaaaccc atcatggcaa   1080
gttaagatcc gtgatgaaat tctgtcttct tgcaaaaatg gtattccaga tgccgaaagt   1140
atcccaaacc ttaaaacagt gactatggtt attcaagaga caatgagatt atacccctcca  1200
gcaccaatcg tcgggagaga agcctctaaa gatatcagat ggggcgatct agttgttcct   1260
aaaggcgtct gtatatggac actaatacca gctttacaca gagatcctga gatttgggga   1320
ccagatgcaa acgatttcaa accagaaaga ttttctgaag gaatttcaaa ggcttgtaag   1380
tatcctcaaa gttacattcc atttggtctg gtcctagaa catgcgttgg taaaaacttt    1440
ggcatgatgg aagtaaaggt tcttgtttcc ctgattgtct ccaagttctc tttcactcta   1500
tctcctacct accaacatag tcctagtcac aaactttttag tagaaccaca acatgggtg   1560
gtaattagag tggtttaa                                                 1578
```

SEQ ID NO: 110
Arabidopsis thaliana

```
MESLVVHTVN AIWCIVIVGI FSVGYHVYGR AVVEQWRMRR SLKLQGVKGP PPSIFNGNVS    60
EMQRIQSEAK HCSGDNIISH DYSSSLFPHF DHWRKQYGRI YTYSTGLKQH LYINHPEMVK   120
ELSQTNTLNL GRITHITKRL NPILGNGIIT SNGPHWAHQR RIIAYEFTHD KIKGMVGLMV   180
ESAMPMLNKW EEMVKRGGEM GCDIRVDEDL KDVSADVIAK ACFGSSFSKG KAIFSMIRDL   240
LTAITKRSVL FRFNGFTDMV FGSKKHGDVD IDALEMELES SIWETVKERE IECKDTHKKD   300
LMQLILEGAM RSCDGNLWDK SAYRRFVVDN CKSIYFAGHD STAVSVSWCL MLLALNPSWQ   360
VKIRDEILSS CKNGIPDAES IPNLKTVTMV IQETMRLYPP APIVGREASK DIRLGDLVVP   420
KGVCIWTLIP ALHRDPEIWG PDANDFKPER FSEGISKACK YPQSYIPFGL GPRTCVGKNF   480
GMMEVKVLVS LIVSKFSFTL SPTYQHSPSH KLLVEPQHGV VIRVV                    525
```

SEQ ID NO: 111
Artificial Sequence

```
atgtacttcc tactacaata cctcaacatc acaaccgttg gtgtctttgc cacattgttt    60
ctctcttatt gtttacttct ctggagaagt agagcgggta acaaaaagat tgccccagaa   120
gctgccgctg catggcctat tatcggccac ctccacttac ttgcaggtgg atcccatcaa   180
ctaccacata ttacattggg taacatggca gataagtacg gtcctgtatt cacaatcaga   240
ataggcttgc atagagctgt agttgtctca tcttgggaaa tggcaaagga atgttcaaca   300
gctaatgatc aagtgtcttc ttcaagacct gaactattca cttctaagtt gttgggttat   360
aactacgcca tgtttggttt ttccaccac ggttcatact ggagagaaat gagaaagatc    420
atctctctcg aattactatc taattccaga ttggaactat tgaaagatgt tagagcctca   480
gaagttgtca catctattaa ggaactatac aaattgtggg cggaaaagaa gaatgagtca   540
ggattggttt ctgtcgagat gaaacaatgg ttcggagatt tgactttaaa cgtgatcttg   600
agaatggtgg ctggtaaaag atacttctcc gcgagtgacg cttcagaaaa caaacaggcc   660
cagcgttgta aagagtcttc cagagaattc ttccatctct ccggcttgtt tgtggttgct   720
gatgctatac ctttttcttgg atggctcgat tgggaagac acgagaagac cttgaaaaag   780
accgccatag aaatggattc catcgcccag gagtggcttg aggaacatag acgtagaaaa   840
gattctggag atgataattc tacccaagat ttcatggacg ttatgcaatc tgtgctagat   900
ggcaaaaatc taggcggata cgatgctgat acgattaaca aggctacatg cttaactctt   960
atatcaggtg gcagtgatac tactgtagtt tctttgacat gggctcttag tcttgtgtta   1020
aacaatagag atacttttgaa aaaggcacag gaagagttag acatccaagt cggtaaggaa  1080
agattggtta acgagcaaga catccagtaag ttagtttact tgcaagcaat agtaaaagag  1140
acactcgagc tttatccacc aggtcctttg ggtggtttga caattcac tgaagattgt     1200
acactaggtg gctatcacgt ttcaaaagga actagattaa tcatgaactt atccaagatt   1260
caaaaagatc cacgtatttg gtctgatcct actgaattcc aaccagagag attccttacg   1320
actcataaag atgtcgatcc acgtggtaaa cactttgaat tcattccatt cggtgcagga   1380
agacgtgcat gtcctggtat cacattcgga ttacaagtac tacatctaac attggcatct   1440
ttcttgcatg cgtttgaatt ttcaacacca tcaaatgagc aggttaacat gagagaatca   1500
ttaggtctta cgaatatgaa atctcccca ttagaagttt tgatttctcc aagactatcc    1560
cttaattgct tcaaccttat gaaaatttga                                     1590
```

SEQ ID NO: 112
Vitis vinifera

```
MYFLLQYLNI TTVGVFATLF LSYCLLLWRS RAGNKKIAPE AAAAWPIIGH LHLLAGGSHQ    60
LPHITLGNMA DKYGPVFTIR IGLHRAVVVS SWEMAKECST ANDQVSSSRP ELLASKLLGY   120
NYAMFGFSPY GSYWREMRKI ISLELLSNSR LELLKDVRAS EVVTSIKELY KLWAEKKNES   180
GLVSVEMKQW FGDLTLNVIL RMVAGKRYFS ASDASENKQA QRCRRVFREF FHLSGLFVVA   240
DAIPFLGWLD WGRHEKTLKK TAIEMDSIAQ EWLEEHRRRK DSGDDNSTQD FMDVMQSVLD   300
GKNLGGYDAD TINKATCLTL ISGGSDTTVV SLTWALSLVL NNRDTLKKAQ EELDIQVGKE   360
RLVNEQDISK LVYLQAIVKE TLRLYPPGPL GGLRQFTEDC TLGGYHVSKG TRLIMNLSKI   420
QKDPRIWSDP TEFQPERFLT THKDVDPRGK HFEFIPFGAG RRACPGITFG LQVLHLTLAS   480
FLHAFEFSTP SNEQVNMRES LGLTNMKSTP LEVLISPRLS SCSLYN                   526
```

SEQ ID NO: 113
Artificial Sequence

```
atggaaccta acttttactt gtcattacta ttgttgttcg tgaccttcat ttctttaagt    60
ctgttttttca tcttttacaa acaaaagtcc ccattgaatt tgccaccagg gaaaatgggt   120
taccctatca taggtgaaag tttagaattc ctatccacag gctggaaggg acatcctgaa   180
aagttcatat tgatagaat gcgtaagtac agtagtgagt tattcaagac ttctattgta    240
ggcaatcca cagttgtttg ctgtggggca gctagtacaa aattcctatt ctctaacgaa   300
aacaaactgg taactgcctg gtggccagat tctgttaaca aaatcttccc aacaacttca   360
ctggattcta atttgaagga ggaatctata aagatgagaa agttgctgcc acagttcttc   420
aaaccagaag cacttcaaag atacgtcggc gttatggatg taatcgcaca aagacatttt   480
gtcactcact gggacaacaa aaatgagatc acagtttatc cacttgctaa aagatacact   540
ttcttgcttg cgtgtagact gttcatgtct gttgaggatg aaaatcatgt ggcgaaattc   600
```

TABLE 19-continued

Sequences disclosed herein.

```
tcagacccat tccaactaat cgctgcaggc atcatttcac ttcctatcga tcttcctggt    660
actccattca acaaggccat aaaggcttca aatttcatta gaaaagagct gataaagatt    720
atcaaacaaa gacgtgttga tctggcagag ggtacagcat ctccaaccca ggatatcttg    780
tcacatatgc tattaacatc tgatgaaaac ggtaaatcta tgaacgagtt gaacattgcc    840
gacaagattc ttggactatt gataggaggc cacgatacag cttcagtagc ttgcacattt    900
ctagtgaagt acttaggaga attaccacat atctacgata aagtctacca agagcaaatg    960
gaaattgcca agtccaaacc tgctgggaaa ttgttgaatt gggatgactt gaaaaagatg   1020
aagtattcat ggaatgtggc atgtgaggta atgagattgt caccacctt acaaggtggt   1080
tttagagagg ctataactga ctttatgttt aacggtttct ctattccaaa agggtggaag   1140
ttatactggt ccgccaactc tacacacaaa aatgcagaat gtttcccaat gcctgagaaa   1200
ttcgatccta ccagatttga aggtaatggt ccagcgcctt atacatttgt accattcggt   1260
ggaggcccta aatgtgtcc tggaaaggaa tacgctagat tagaaatctt ggttttcatg   1320
cataatctgg tcaaacgttt taagtgggaa aaggttattc cagacgaaaa gattattgtc   1380
gatccattcc caatcccagc taaagatctt ccaatccgtt tgtatcctca caaagcttaa   1440
```

SEQ ID NO: 114
*Medicago truncatula*

```
MEPNFYLSLL LLFVTPISLS LFFIFYKQKS PLNLPPGKMG YPIIGESLEF LSTGWKGHPE     60
KPIFDRMRKY SSELFKTSIV GESTVVCCGA ASNKFLFSNE NKLVTAWWPD SVNKIFPTTS    120
LDSNLKEESI KMRKLLPQFF KPEALQRYVG VMDVIAQRHF VTHWDNKNEI TVYPLAKRYT    180
FLLACRLFMS VEDENHVAKF SDPFQLIAAG IISLPIDLPG TPFNKAIKAS NFIRKELIKI    240
IKQRRVDLAE GTASPTQDIL SHMLLTSDEN GKSMNELNIA DKILGLLIGG HDTASVACTF    300
LVKYLGELPH IYDKVYQEQM EIAKSKPAGE LLNWDDLKKM KYSWNVACEV MRLSPPLQQG    360
FREAITDFMF NGFSIPKGWK LYWSANSTHK NAECFPMPEK FDPTRFEGNG PAPYTFVPFG    420
GGPRMCPGKE YARLEILVFM HNLVKRFKWE KVIPDEKIIV DPFPIPAKDL PIRLYPHKA     479
```

SEQ ID NO: 115
Artificial Sequence

```
atggcctctg ttactttggg ttcctggatc gtcgtccacc accataacca tcaccatcca     60
tcatctatcc taactaaatc tcgttcaaga tcctgtccta ttacactaac caaaccaatc    120
tcttttcgtt caaagagaac agtttcctct agtagttcta tcgtgtcctc tagtgtcgtc    180
actaaggaag acaatctgag acagtctgaa ccttcttcct ttgatttcat gtcatatatc    240
attactaagg cagaactagt gaataaggct cttgattcag cagttccatt aagagagcca    300
ttgaaaatcc atgaagcaat gagatactct cttctagctg cgggaagag agtcagacct    360
gtactctgca tagcagcgtg cgaattagtt ggtggcgagg aatcaaccgc tatgcctgcc    420
gcttgtgctg tagaaatgat tcatacaatg tcactgatac acgatgattt gccatgtatg    480
gataacgatg atctgagaag gggtaagcca actaaccata aggttttcgg cgaagatgtt    540
gccgtcttag ctggtgatgc tttgttatct ttcgcgttcg aacatttggc atccgcaaca    600
tcaagtgatg ttgtgtcacc agtaagagta gttagagcag ttggagaact ggctaaagct    660
attggaactg aggtttagt tgcaggtcaa gtcgtcgatta tctcttccga aggtcttgat    720
ttgaatgatg taggtcttga acatctcgaa ttcatccatc ttcacaagac agctgcactt    780
ttagaagcca gtgcggttct cggcgcaatt gttggcggag ggagtgatga cgaaattgag    840
agattgagga agtttgctag atgtataggt ttactgttcc aagtagtaga cgatatacta    900
gatgtgacaa agtcttccaa agagttggga aaaacagctg gtaaagattt gattgccgac    960
aaattgacct acccctaagat tatggggcta gaaaaatcaa gagaatttgc cgagaaactc   1020
aatagagagg cgcgtgatca actgttgggt ttcgattctg ataaagttgc accactctta   1080
gccttagcca actacatcgc ttacagacaa aactaa                              1116
```

SEQ ID NO: 116
*Arabidopsis thaliana*

```
MASVTLGSWI VVHHHNHHHP SSILTKSRSR SCPITLTKPI SFRSKRTVSS SSSIVSSSVV     60
TKEDNLRQSE PSSFDFMSYI ITKAELVNKA LDSAVPLREP LKIHEAMRYS LLAGGKRVRP    120
VLCIAACELV GGEESTAMPA ACAVEMIHTM SLIHDDLPCM DNDDLRRGKP TNHKVFGEDV    180
AVLAGDALLS FAFEHLASAT SSDVVSPVRV VRAVGELAKA IGTEGLVAGQ VVDISSEGLD    240
LNDVGLEHLE FIHLHKTAAL LEASAVLGAI VGGGSDDEIE RLRKFARCIG LLFQVVDDIL    300
DVTKSSKELG KTAGKDLIAD KLTYPKIMGL EKSREFAEKL NREARDQLLG FDSDKVAPLL    360
ALANYIAYRQ N                                                          371
```

SEQ ID NO: 117
*Rubus suavissimus*

```
MATLLEHFQA MPFAIPIALA ALSWLFLFYI KVSFFSNKSA QAKLPPVPVV PGLPVIGNLL     60
QLKEKKPYQT FTRWAEEYGP IYSIRTGAST MVVLNTTQVA KEAMVTRYLS ISTRKLSNAL    120
KILTADKCMV AISDYNDFHK MIKRYILSNV LGPSAQKRHR SNRDTLRANV CSRLHSQVKN    180
SPREAVNFRR VFEWELFGIA LKQAFGKDIE KPIYVEELGT TLSRDEIFKV LVLDIMEGAI    240
EVDWRDFFPY LRWIPNTRME TKIQRLYFRR KAVMTALINE QKKRIASGEE INCYIDFLLK    300
EGKTLTMDQI SMLLWETVIE TADTTMVTTE WAMYEVAKDS KRQDRLYQEI QKVCGSEMVT    360
EEYLSQLPYL NAVFHETLRK HSPAALVPLR YAHEDTQLGG YYIPAGTEIA INIYGCNMDK    420
HQWESPEEWK PERFLDPKFD PMDLYKTMAF GAGKRVCAGS LQAMLIACPT IGRLVQEFEW    480
KLRDGEEENV DTVGLTTHKR YPMHAILKPR S                                    511
```

SEQ ID NO: 118
Artificial Sequence

```
MAEQQKIKKS PHVLLIPFPL QGHINPFIQF GKRLISKGVK TTLVTTIHTL NSTLNHSNTT     60
TTSIEIQAIS DGCDEGGFMS AGESYLETFK QVGSKSLADL IKKLQSEGTT IDAIIYDSMT    120
EWVLDVAIEF GIDGGSFFTQ ACVVNSLYYH VHKGLISLPL GETVSVPGFP VLQRWETPLI    180
LQNHEQIQSP WSQMLFGQFA NIDQARWVFT NSFYKLEEEV IEWTRKIWNL KVIGPTLPSM    240
YLDKRLDDDK DNGFNLYKAN HHECMNWLDD KPKESVVYVA FGSLVEHGPE QVEEITRALI    300
DSDVNFLWVI KHKEEGKLPE NLSEVIKTGK GLIVAWCKQL DVLAHESVGC FVTHCGFNST    360
```

| | | | | | |
|---|---|---|---|---|---|
| LEAISLGVPV | VAMPQFSDQT | TNAKLLDEIL | GVGVRVKADE | NGIVRRGNLA | SCIKMIMEEE | 420
| RGVIIRKNAV | KWKDLAKVAV | HEGGSSDNDI | VEFVSELIKA | | | 460

SEQ ID NO: 119
Artificial Sequence

```
atggctgaac aacaaaagat caagaagtct ccacacgttt tgttgattcc atttccattg   60
caaggtcaca tcaacccatt cattcaattc ggtaagagat tgatttccaa gggtgttaag  120
actactttgg ttactaccat ccataccttg aactctacct tgaaccattc taacactacc  180
accacctcca ttgaaattca agctatttcc gatggttgtg atgaaggtgg ttttgtttct  240
gctggtgaat cttacttgga aacctttaag caagttggtt ctaagtcctt ggccgatttg  300
attaagaagt tgcaatctga aggtactacc attgatgcca ttatctacga ttctatgacc  360
gaatgggttt tggatgttgc tattgaattc ggtattgatg gtggttcatt cttcactcaa  420
gcttgtgttg ttaactcctt gtactaccat gttcacaagg gtttgatctc attgccattg  480
ggtgaaactg tttctgttcc aggtttccca gttttacaaa gatgggaaac tccattgatc  540
ttgcaaaacc acgaacaaat tcaatctcca tggtcccaaa tgttgtttgg tcaattcgcc  600
aacattgatc aagctagatg ggttttttacc aactccttct acaagttgga agaagaagtt  660
atcgaatgga ccagaaagat ctggaacttg aaagttattg gtccaaacct tgccatctatg  720
tacttggata agagattgga tgacgataag gacaacggtt tcaacttgta caaggctaac  780
catgatgaat gcatgaattg gttggacgac aagccaaagg aatccgttgt ttatgttgct  840
ttcggttctt tggtcaaaca tggtccagaa caagttgaag aaattaccag agccttgatc  900
gattccgatg ttaatttctt gtgggtcatc aagcacaaag aagaaggtaa attgccagaa  960
aacttgtccg aagttatcaa aactggtaag ggtttgattg tcgcttggtg taaacaattg 1020
gatgttttgg ctcatgaatc cgttggttgt ttcgttactc atggtggttt caactccacc 1080
ttggaagcta tttctttggg tgttccagtt gttgctatgc cacaatttttc tgatcaaact 1140
accaacgcta agttgttgga cgaaattttg ggtgttggtg ttagagttaa ggctgacgaa 1200
aatggtatcg ttagaagagg taacttggct tcttgcatca gatgatcat ggaagaagaa 1260
agaggtgtca tcattagaaa gaacgctgtt aagtggaagg atttggctaa agttgctgtt 1320
catgaaggtg gtagttccga taatgatatc gttgaattcg tttccgaatt gatcaaggcc 1380
taa                                                                1383
```

SEQ ID NO: 120
Artificial Sequence

| | | | | | |
|---|---|---|---|---|---|
| MAEQQKIKKS | PHVLLIPFPL | QGHINPFIQF | GKRLISKGVK | TTLVTTIHTL | NSTLNHSNTT | 60
| TTSIEIQAIS | DGCDEGGFVS | AGESYLETFK | QVGSKSLADL | IKKLQSEGTT | IDAIIYDSMT | 120
| EWVLDVAIEF | GIDGGSFFTQ | ACVVNSLYYH | VHKGLISLPL | GETVSVPGFP | VLQRWETPLI | 180
| LQNHEQIQSP | WSQMLFGQFA | NIDQARWVFT | NSFYKLEEEV | IEWTRKIWNL | KVIGPTLPSM | 240
| YLDKRLDDDK | DNGFNLYKAN | HHECMNWLDD | KPKESVVYVA | FGSLVKHGPE | QVEEITRALI | 300
| DSDVNFLWVI | KHKEEGKLPE | NLSEVIKTGK | GLIVAWCKQL | DVLAHESVGC | FVTHCGFNST | 360
| LEAISLGVPV | VAMPQFSDQT | TNAKLLDEIL | GVGVRVKADE | NGIVRRGNLA | SCIKMIMEEE | 420
| RGVIIRKNAV | KWKDLAKVAV | HEGGSSDNDI | VEFVSELIKA | | | 460

SEQ ID NO: 121
Artificial Sequence

```
atggctgaac aacaaaagat caagaagtct ccacacgttt tgttgattcc atttccattg   60
caaggtcaca tcaacccatt cattcaattc ggtaagagat tgatttccaa gggtgttaag  120
actactttgg ttactaccat ccatacctgt aactctacct tgaaccattc taacactacc  180
accacctcca ttgaaattca agctatttcc gatggttgtg atgaaggtgg tttttatgtct  240
gctggtgaat cttacttgga aacctttaag caagttggtt ctaagtcctt ggccgatttg  300
attaagaagt tgcaatctga aggtactacc attgatgcca ttatctacga ttctatgacc  360
gaatgggttt tggatgttgc tattgaattc ggtattgatg gtggttcatt cttcactcaa  420
gcttgtgttg ttaactcctt gtactaccat gttcacaagg gtttgatctc attgccattg  480
ggtgaaactg tttctgttcc aggtttccca gttttacaaa gatgggaaac tccattgatc  540
ttgcaaaacc acgaacaaat tcaatctcca tggtcccaaa tgttgtttgg tcaattcgcc  600
aacattgatc aagctagatg ggttttttacc aactccttct acaagttgga agaagaagtt  660
atcgaatgga ccagaaagat ctggaacttg aaagttattg gtccaaacct tgccatctatg  720
tacttggata agagattgga tgacgataag gacaacggtt tcaacttgta caaggctaac  780
catgatgaat gcatgaattg gttggacgac aagccaaagg aatccgttgt ttatgttgct  840
ttcggttctt tggtcaaaca tggtccagaa caagttgaag aaattaccag agccttgatc  900
gattccgatg ttaatttctt gtgggtcatc aagcacaaag aagaaggtaa attgccagaa  960
aacttgtccg aagttatcaa aactggtaag ggtttgattg tcgcttggtg taaacaattg 1020
gatgttttgg ctcatgaatc cgttggttgt ttcgttactc atggtggttt caactccacc 1080
ttggaagcta tttctttggg tgttccagtt gttgctatgc cacaatttca gatcaaact 1140
accaacgcta agttgttgga cgaaattttg ggtgttggtg ttagagttaa ggctgacgaa 1200
aatggtatcg ttagaagagg taacttggct tcttgcatca gatgatcat ggaagaagaa 1260
agaggtgtca tcattagaaa gaacgctgtt aagtggaagg atttggctaa agttgctgtt 1320
catgaaggtg gtagttccga taatgatatc gttgaattcg tttccgaatt gatcaaggcc 1380
taa                                                                1383
```

SEQ ID NO: 122
Artificial Sequence

| | | | | | |
|---|---|---|---|---|---|
| MAEQQKIKKS | PHVLLIPFPL | QGHINPFIQF | GKRLISKGVK | TTLVTTIHTL | NSTLNHSNTT | 60
| TTSIEIQAIS | DGCDEGGFMS | AGESYLETFK | QVGSKSLADL | IKKLQSEGTT | IDAIIYDSMT | 120
| EWVLDVAIEF | GIDGGSFFTQ | ACVVNSLYYH | VHKGLISLPL | GETVSVPGFP | VLQRWETPLI | 180
| LQNHEQIQSP | WSQMLFGQFA | NIDQARWVFT | NSFYKLEEEV | IEWTRKIWNL | KVIGPTLPSM | 240
| YLDKRLDDDK | DNGFNLYKAN | HHECMNWLDD | KPKESVVYVA | FGSLVKHGPE | QVEEITRALI | 300
| DSDVNFLWVI | KHKEEGKLPE | NLSEVIKTGK | GLIVAWCKQL | DVLAHESVGC | FVTHCGFNST | 360
| LEAISLGVPV | VAMPQFQDQT | TNAKLLDEIL | GVGVRVKADE | NGIVRRGNLA | SCIKMIMEEE | 420
| RGVIIRKNAV | KWKDLAKVAV | HEGGSSDNDI | VEFVSELIKA | | | 460

TABLE 19-continued

Sequences disclosed herein.

SEQ ID NO: 123
Artificial Sequence
```
atggctgaac aacaaaagat caagaagtct ccacacgttt tgttgattcc atttccattg    60
caaggtcaca tcaacccatt cattcaattc ggtaagagat tgatttccaa gggtgttaag   120
actactttgg ttactaccat ccataccttg aactctacct tgaaccattc taacactacc   180
accacctcca ttgaaattca agctatttcc gatggttgtg atgaaggtgg ttttatgtgt   240
gctggtgaat cttacttgga aacctttaag caagttggt ctaagtcctt ggccgatttg   300
attaagaagt tgcaatctga aggtactacc attgatgcca ttatctacga ttctatgacc   360
gaatgggttt tggatgttgc tattgaattc ggtattgatg gtggtcatt cttcactcaa   420
gcttgtgttg ttaactcctt gtactaccat gttcacaagg gtttgatctc attgccattg   480
ggtgaaactg tttctgttcc aggtttccca gtttacaaa gatgggaaac tccattgatc   540
ttgcaaaacc acgaacaaat tcaatctcca tggtcccaaa tgttgtttgg tcaattcgcc   600
aacattgatc aagctagatg ggtttttacc aactccttct acaagttgga agaagaagtt   660
atcgaatgga ccagaaagat ctggaacttg aaagttattg gtccaacctt gccatctatg   720
tacttggata agagattgga tgacgataag gacaacggtt tcaacttgta caaggctacc   780
catcatgaat gcatgaattg gttggacgac aagccaaaag aatccgttgt ttatgttgct   840
ttcggttctt tggtcaaaca tggtccagaa caagttgaag aaattaccag agccttgatc   900
gattccgatg ttaatttctt gtgggtcatc aagcacaaag aagaaggtaa attgccagaa   960
aacttgtccg aagttatcaa aactggtaag ggtttgattg tcgcttggtg taaacaattg  1020
gatgttttgg ctcatgaatc cgttggttgt ttcgttactc attgtggttt caactccacc  1080
ttggaagcta tttctttggg tgttccagtt gttgctatgc cacaattttc tgatcaaact  1140
accaacgcta agttgttgga cgaaattttg ggtgttggtg ttagagttaa ggctgacgaa  1200
aatggtatcg ttagaagagg taacttggct tcttgcatca agatgatcat ggaagaagaa  1260
agaggtgtca tcattagaaa gaacgctgtt aagtggaagg atttggctaa agttgctgtt  1320
catgaaggtg gtagttccga taatgatatc gttgaattcg tttccgaatt gatcaaggcc  1380
taa                                                                1383
```

SEQ ID NO: 124
Artificial Sequence
```
MAEQQKIKKS PHVLLIPFPL QGHINPFIQF GKRLISKGVK TTLVTTIHTL NSTLNHSNTT    60
TTSIEIQAIS DGCDEGGFMC AGESYLETFK QVGSKSLADL IKKLQSEGTT IDAIIYDSMT   120
EWVLDVAIEF GIDGGSFFTQ ACVVNSLYYH VHKGLISLPL GETVSVPGFP VLQRWETPLI   180
LQNHEQIQSP WSQMLFGQFA NIDQARWVFT NSFYKLEEEV IEWTRKIWNL KVIGPTLPSM   240
YLDKRLDDDK DNGFNLYKAN HHECMNWLDD KPKESVVYVA FGSLVKHGPE QVEEITRALI   300
DSDVNFLWVI KHKEEGKLPE NLSEVIKTGK GLIVAWCKQL DVLAHESVGC FVTHCGFNST   360
LEAISLGVPV VAMPQFSDQT TNAKLLDEIL GVGVRVKADE NGIVRRGNLA SCIKMIMEEE   420
RGVIIRKNAV KWKDLAKVAV HEGGSSDNDI VEFVSELIKA                         460
```

SEQ ID NO: 125
Artificial Sequence
```
atggctgaac aacaaaagat caagaagtct ccacacgttt tgttgattcc atttccattg    60
caaggtcaca tcaacccatt cattcaattc ggtaagagat tgatttccaa gggtgttaag   120
actactttgg ttactaccat ccataccttg aactctacct tgaaccattc taacactacc   180
accacctcca ttgaaattca agctatttcc gatggttgtg atgaaggtgg ttttatgtct   240
gctggtgaat cttacttgga aacctttaag caagttggt ctaagtcctt ggccgatttg   300
attaagaagt tgcaatctga aggtactacc attgatgcca ttatctacga ttctatgacc   360
gaatgggttt tggatgttgc tattgaattc ggtattgatg gtggtcatt cttcactcaa   420
gcttgtgttg ttaactcctt gtactaccat gttcacaagg gtttgatctc attgccattg   480
ggtgaaactg tttctgttcc aggtttccca gtttacaaa gatgggaaac tccattgatc   540
ttgcaaaacc acgaacaaat tcaatctcca tggtcccaaa tgttgtttgg tcaattcgcc   600
aacattgatc aagctagatg ggtttttacc aactccttct acaagttgga agaagaagtt   660
atcgaatgga ccagaaagat ctggaacttg aaagttattg gtccaacctt gccatctatg   720
tacttggata agagattgga tgacgataag gacaacggtt tcaacttgta caaggctacc   780
catcatgaat gcatgaattg gttggacgac aagccaaaag aatccgttgt ttatgttgct   840
ttcggttctt tggtctgtca tggtccagaa caagttgaag aaattaccag agccttgatc   900
gattccgatg ttaatttctt gtgggtcatc aagcacaaag aagaaggtaa attgccagaa   960
aacttgtccg aagttatcaa aactggtaag ggtttgattg tcgcttggtg taaacaattg  1020
gatgttttgg ctcatgaatc cgttggttgt ttcgttactc attgtggttt caactccacc  1080
ttggaagcta tttctttggg tgttccagtt gttgctatgc cacaattttc tgatcaaact  1140
accaacgcta agttgttgga cgaaattttg ggtgttggtg ttagagttaa ggctgacgaa  1200
aatggtatcg ttagaagagg taacttggct tcttgcatca agatgatcat ggaagaagaa  1260
agaggtgtca tcattagaaa gaacgctgtt aagtggaagg atttggctaa agttgctgtt  1320
catgaaggtg gtagttccga taatgatatc gttgaattcg tttccgaatt gatcaaggcc  1380
taa                                                                1383
```

SEQ ID NO: 126
Artificial Sequence
```
MAEQQKIKKS PHVLLIPFPL QGHINPFIQF GKRLISKGVK TTLVTTIHTL NSTLNHSNTT    60
TTSIEIQAIS DGCDEGGFMS AGESYLETFK QVGSKSLADL IKKLQSEGTT IDAIIYDSMT   120
EWVLDVAIEF GIDGGSFFTQ ACVVNSLYYH VHKGLISLPL GETVSVPGFP VLQRWETPLI   180
LQNHEQIQSP WSQMLFGQFA NIDQARWVFT NSFYKLEEEV IEWTRKIWNL KVIGPTLPSM   240
YLDKRLDDDK DNGFNLYKAT HHECMNWLDD KPKESVVYVA FGSLVCHGPE QVEEITRALI   300
DSDVNFLWVI KHKEEGKLPE NLSEVIKTGK GLIVAWCKQL DVLAHESVGC FVTHCGFNST   360
LEAISLGVPV VAMPQFSDQT TNAKLLDEIL GVGVRVKADE NGIVRRGNLA SCIKMIMEEE   420
RGVIIRKNAV KWKDLAKVAV HEGGSSDNDI VEFVSELIKA                         460
```

TABLE 19-continued

Sequences disclosed herein.

SEQ ID NO: 127
Artificial Sequence
```
atggctgaac aacaaaagat caagaagtct ccacacgttt tgttgattcc atttccattg    60
caaggtcaca tcaacccatt cattcaattc ggtaagagat tgatttccaa gggtgttaag   120
actactttgg ttactaccat ccataccttg aactctacct tgaaccattc taacactacc   180
accacctcca ttgaaattca agctatttcc gatggttgtg atgaaggtgg ttttatgtct   240
gctggtgaat cttacttgga aacctttaag caagttggt  ctaagtcctt ggccgatttg   300
attaagaagt tgcaatctga aggtactacc attgatgcca ttatctacga ttctatgacc   360
gaatgggttt tggatgttgc tattgaattc ggtattgatg gtggtcatt  cttcactcaa   420
gcttgtgttg ttaactcctt gtactaccat gttcacaagg gtttgatctc attgccattg   480
ggtgaaactg tttctgttcc aggtttccca gtttacaagg gatgggaaac tccattgatc   540
ttgcaaaacg ttgaacaaat tcaatctcca tggtcccaaa tgttgtttgg tcaattcgcc   600
aacattgatc aagctagatg ggtttttacc aactccttct acaagttgga agaagaagtt   660
atcgaatgga ccagaaagat ctggaacttg aaagttattg gtccaacctt gccatctatg   720
tacttggata agagattgga tgacgataag gacaacggtt tcaacttgta caaggctaac   780
catcatgaat gcatgaattg gttggacgac aagccaaaag aatccgttgt ttatgttgct   840
ttcggttctt tggtcaaaca tggtccagaa caagttgaag aaattaccag agccttgatc   900
gattccgatg ttaatttctt gtgggtcatc aagcacaaag aagaaggtaa attgccagaa   960
aacttgtccg aagttatcaa aactggtaag ggtttgattg tcgcttggtg taaacaattg  1020
gatgttttgg ctcatgaatc cgttggttgt ttcgttactc attgtggttt caactccacc  1080
ttggaagcta tttctttggg tgttccagtt gttgctatgc cacaattttc tgatcaaact  1140
accaacgcta agttgttgga cgaaattttg ggtgttggtg ttagagttaa ggctgacgaa  1200
aatggtatcg ttagaagagg taacttggct tcttgcatca agatgatcat ggaagaagaa  1260
agaggtgtca tcattagaaa gaacgctgtt aagtggaagg atttggctaa agttgctgtt  1320
catgaaggtg gtagttccga taatgatatc gttgaattcg tttccgaatt gatcaaggcc  1380
taa                                                                1383
```

SEQ ID NO: 128
Artificial Sequence
```
MAEQQKIKKS PHVLLIPFPL QGHINPFIQF GKRLISKGVK TTLVTTIHTL NSTLNHSNTT    60
TTSIEIQAIS DGCDEGGFMS AGESYLETFK QVGSKSLADL IKKLQSEGTT IDAIIYDSMT   120
EWVLDVAIEF GIDGGSFFTQ ACVVNSLYYH VHKGLISLPL GETVSVPGFP VLQRWETPLI   180
LQNVEQIQSP WSQMLFGQFA NIDQARWVFT NSFYKLEEEV IEWTRKIWNL KVIGPTLPSM   240
YLDKRLDDDK DNGFNLYKAN HHECMNWLDD KPKESVVYVA FGSLVKHGPE QVEEITRALI   300
DSDVNFLWVI KHKEEGKLPE NLSEVIKTGK GLIVAWCKQL DVLAHESVGC FVTHCGFNST   360
LEAISLGVPV VAMPQFSDQT TNAKLLDEIL GVGVRVKADE NGIVRRGNLA SCIKMIMEEE   420
RGVIIRKNAV KWKDLAKVAV HEGGSSDNDI VEFVSELIKA                         460
```

SEQ ID NO: 129
Artificial Sequence
```
atggctgaac aacaaaagat caagaagtct ccacacgttt tgttgattcc atttccattg    60
caaggtcaca tcaacccatt cattcaattc ggtaagagat tgatttccaa gggtgttaag   120
actactttgg ttactaccat ccataccttg aactctacct tgaaccattc taacactacc   180
accacctcca ttgaaattca agctatttcc gatggttgtg atgaaggtgg ttttatgtct   240
tggggtaaat cttacttgga aacctttaag caagttggt  ctaagtcctt ggccgatttg   300
attaagaagt tgcaatctga aggtactacc attgatgcca ttatctacga ttctatgacc   360
gaatgggttt tggatgttgc tattgaattc ggtattgatg gtggtcatt  cttcactcaa   420
gcttgtgttg ttaactcctt gtactaccat gttcacaagg gtttgatctc attgccattg   480
ggtgaaactg tttctgttcc aggtttccca gtttacaaa  gatgggaaac tccattgatc   540
ttgcaaaacc acgaacaaat tcaatctcca tggtcccaaa tgttgtttgg tcaattcgcc   600
aacattgatc aagctagatg ggtttttacc aactccttct acaagttgga agaagaagtt   660
atcgaatgga ccagaaagat ctggaacttg aaagttattg gtccaacctt gccatctatg   720
tacttggata agagattgga tgacgataag gacaacggtt tcaacttgta caaggctaac   780
catcatgaat gcatgaattg gttggacgac aagccaaaag aatccgttgt ttatgttgct   840
ttcggttctt tggtcaaaca tggtccagaa caagttgaag aaattaccag agccttgatc   900
gattccgatg ttaatttctt gtgggtcatc aagcacaaag aagaaggtaa attgccagaa   960
aacttgtccg aagttatcaa aactggtaag ggtttgattg tcgcttggtg taaacaattg  1020
gatgttttgg ctcatgaatc cgttggttgt ttcgttactc attgtggttt caactccacc  1080
ttggaagcta tttctttggg tgttccagtt gttgctatgc cacaattttc tgatcaaact  1140
accaacgcta agttgttgga cgaaattttg ggtgttggtg ttagagttaa ggctgacgaa  1200
aatggtatcg ttagaagagg taacttggct tcttgcatca agatgatcat ggaagaagaa  1260
agaggtgtca tcattagaaa gaacgctgtt aagtggaagg atttggctaa agttgctgtt  1320
catgaaggtg gtagttccga taatgatatc gttgaattcg tttccgaatt gatcaaggcc  1380
taa                                                                1383
```

SEQ ID NO: 130
Artificial Sequence
```
MAEQQKIKKS PHVLLIPFPL QGHINPFIQF GKRLISKGVK TTLVTTIHTL NSTLNHSNTT    60
TTSIEIQAIS DGCDEGGFMS WGKSYLETFK QVGSKSLADL IKKLQSEGTT IDAIIYDSMT   120
EWVLDVAIEF GIDGGSFFTQ ACVVNSLYYH VHKGLISLPL GETVSVPGFP VLQRWETPLI   180
LQNHEQIQSP WSQMLFGQFA NIDQARWVFT NSFYKLEEEV IEWTRKIWNL KVIGPTLPSM   240
YLDKRLDDDK DNGFNLYKAN HHECMNWLDD KPKESVVYVA FGSLVKHGPE QVEEITRALI   300
DSDVNFLWVI KHKEEGKLPE NLSEVIKTGK GLIVAWCKQL DVLAHESVGC FVTHCGFNST   360
LEAISLGVPV VAMPQFSDQT TNAKLLDEIL GVGVRVKADE NGIVRRGNLA SCIKMIMEEE   420
RGVIIRKNAV KWKDLAKVAV HEGGSSDNDI VEFVSELIKA                         460
```

TABLE 19-continued

Sequences disclosed herein.

SEQ ID NO: 131
Artificial Sequence

| | | | | | |
|---|---|---|---|---|---|
| atggatgcta | tggctaccac | cgaaaaaaag | ccacatgtta | ttttcattcc | attcccagct | 60 |
| caatcccata | ttaaggctat | gttgaagttg | gcccaattat | tgcatcacaa | gggtttacaa | 120 |
| atcaccttcg | ttaacaccga | cttcatccac | aatcaattct | ggaatcttc | tggtccacat | 180 |
| tgcttggatg | gtgctccagg | ttttagattt | gaaactattc | cagatggtgt | ttcccattct | 240 |
| ccagaagctt | ctattccaat | tagagaaatcc | ttgttgagat | ccatcgaaac | taatttcttg | 300 |
| gacagattca | tcgacttggt | tactaagttg | ccagatccac | caacctgtat | tatttctgat | 360 |
| ggtttcttgt | ccgttttcac | cattgatgct | gctaagaaat | tgggtatccc | agttatgatg | 420 |
| tactggactt | tggctgcttg | tggttttatg | ggttctacc | atatccattc | cttgatcgaa | 480 |
| aagggttttg | ctccattgaa | agatgcctct | tacttgacta | acggttactt | ggataccgct | 540 |
| attgattggg | ttccaggtat | ggaaggtatc | agattgaagg | attttccatt | ggattggtcc | 600 |
| actgatttga | cgataaggt | tttgatgttc | actaccgaag | ctccacaaag | atctcataag | 660 |
| gtttcccatc | atatcttcca | caccttcgat | gaattggaac | atccattat | aagaccttg | 720 |
| tccttgagat | acaaccacat | ctataccatt | ggtcattgc | aattattat | ggaccaaatc | 780 |
| ccagaagaaa | agaagcaaac | tggtattact | tccttgcacg | ttactcatt | ggtcaaagaa | 840 |
| gaaccagaat | gcttccaatg | gttgcaatct | aaagaaccta | actccgttgt | ctacgttaac | 900 |
| tttggttcta | ctaccgttat | gtccttggaa | gatatgactg | aatttggttg | gggtttggct | 960 |
| aactctaacc | attacttctt | gtggatcatc | agatccaatc | tggttattgg | tgaaaacgct | 1020 |
| gttttgccac | cagaattgga | agaacatatc | aagaagagag | gtttcattgc | ttcttggtgt | 1080 |
| tcccaagaaa | aggttttgaa | acatccatct | gtcggtggtt | tcttgactca | ttgtggttgg | 1140 |
| ggttctacca | ttgaatcttt | gtctgctggt | gttccaatga | tttgttggcc | atattcttgg | 1200 |
| gatcaattga | ccaactgcag | atacatctgc | aaagaatgg | actcggttt | ggaaatgggt | 1260 |
| acaaaagtca | aaagagatga | agtcaagaga | ttggtccaag | aattgatgg | tgaaggtggt | 1320 |
| cataagatga | gaaacaaagc | caaggactgg | aaagaaaagg | ctagaattgc | tattgctcca | 1380 |
| aacggttctt | cctctttgaa | cattgacaag | atggtcaaag | aaatcaccgt | tttggccaga | 1440 |
| aacagagcct | cctccaccaa | actagtaaaa | atggctgaac | aacaaaagat | caagaagtct | 1500 |
| ccacacgttt | tgttgattcc | atttccattg | caaggtcaca | tcaacccatt | cattcaattc | 1560 |
| ggtaagagat | tgatttccaa | gggtgttaag | actactttgg | ttactaccat | ccataccttg | 1620 |
| aactctacct | tgaaccattc | taacactacc | accacctcca | ttgaaattca | agctatttcc | 1680 |
| gatggttgtg | atgaaggtgg | ttttatgtct | gctggtgaat | cttacttgga | aacctttaag | 1740 |
| caagttggtt | ctaagtcctt | ggccgatttg | attaagaagt | tgcaatctga | aggtactacc | 1800 |
| attgatgcca | ttatctacga | ttctatgacc | gaatgggttt | tggatgttgc | tattgaattc | 1860 |
| ggtattgatg | gtggttcatt | cttcactcaa | gcttgtgttg | ttaactcctt | gtactaccat | 1920 |
| gttcacaagg | gtttgatctc | attgccattg | ggtgaaactg | tttctgttcc | aggttctcca | 1980 |
| gttttacaag | gatgggaaac | tccattgatc | ttgcaaaacc | agaacaaat | tcaatctcca | 2040 |
| tggtcccaaa | tgttgtttgg | tcaattcgcc | aacattgatc | aagctagatg | ggttttacc | 2100 |
| aactccttct | acaagttgga | agaagaagtt | atcgaatgga | ccagaaagat | ctggaacttg | 2160 |
| aaagttattg | gtccaacctt | gccatctatg | tacttggata | agagattgga | tgacgataag | 2220 |
| gacaacggtt | tcaacttgta | caaggctaac | catcatgaat | gcatgaattg | gttggacgac | 2280 |
| aagccaaaag | aatccgttgt | ttatgttgct | ttcggttctt | tggtcaaaca | tggtccagaa | 2340 |
| caagttgaag | aaattaccag | agccttgatc | gattccgatg | ttaatttctt | gtgggtcatc | 2400 |
| aagcacaaag | aagaaggtaa | attgccagaa | aacttgtccg | aagttatcaa | aactggtaag | 2460 |
| ggtttgattg | tcgcttggtg | taaacaattg | gatgttttgg | ctcatgaatc | cgttggtgt | 2520 |
| ttcgttactc | attgtggttt | caactccacc | ttggaagcta | tttcttggg | tgttccagtt | 2580 |
| gttgctatgc | cacaattttc | tgatcaaact | accaacgcta | agtgttgga | cgaaattttg | 2640 |
| ggtgttggtg | ttagagttaa | ggctgacgaa | aatggtatcg | ttagaagagg | taacttggct | 2700 |
| tcttgcatca | agatgatcat | ggaagaagaa | agaggtgtca | tcattagaaa | gaacgctgtt | 2760 |
| aagtggaagg | atttggctaa | agttgctgtt | catgaaggtg | gtagttccga | taatgatatc | 2820 |
| gttgaattcg | tttccgaatt | gatcaaggcc | taa | | | 2853 |

SEQ ID NO: 132
Artificial Sequence

| | | | | | |
|---|---|---|---|---|---|
| MDAMATTEKK | PHVIFIPFPA | QSHIKAMLKL | AQLLHHKGLQ | ITFVNTDFIH | NQFLESSGPH | 60 |
| CLDGAPGFRF | ETIPDGVSHS | PEASIPIRES | LLRSIETNFL | DRFIDLVTKL | PDPPTCIISD | 120 |
| GFLSVFTIDA | AKKLGIPVMM | YWTLAACGFM | GFYHIHSLIE | KGFAPLKDAS | YLTNGYLDTV | 180 |
| IDWVPGMEGI | RLKDFPLDWS | TDLNDKVLMF | TTEAPQRSHK | VSHHIFHTFD | ELEPSIIKTL | 240 |
| SLRYNHIYTI | GPLQLLLDQI | PEEKKQTGIT | SLHGYSLVKE | EPECFQWLQS | KEPNSVVYVN | 300 |
| FGSTTVMSLE | DMTEFGWGLA | NSNHYFLWII | RSNLVIGENA | VLPPELEEHI | KKRGFIASWC | 360 |
| SQEKVLKHPS | VGGFLTHCGW | GSTIESLSAG | VPMICWPYSW | DQLTNCRYIC | KEWEVGLEMG | 420 |
| TKVKRDEVKR | LVQELMGEGG | HKMRNKAKDW | KEKARIAIAP | NGSSSLNIDK | MVKEITVLAR | 480 |
| NRASSTKLVK | MAEQQKIKKS | PHVLLIPFPL | QGHINPFIQF | GKRLISKGVK | TTLVTTIHTL | 540 |
| NSTLNHSNTT | TTSIEIQAIS | DGCDEGGFMS | AGESYLETFK | QVGSKSLADL | IKKLQSEGTT | 600 |
| IDAIIYDSMT | EWVLDVAIEF | GIDGGSFFTQ | ACVVNSLYYH | VHKGLISLPL | GETVSVPGFP | 660 |
| VLQRWETPLI | LQNHEQIQSP | WSQMLFGQFA | NIDQARWVFT | NSFYKLEEEV | IEWTRKIWNL | 720 |
| KVIGPTLPSM | YLDKRLDDDK | DNGFNLYKAN | HHECMNWLDD | KPKESVVYVA | FGSLVKHGPE | 780 |
| QVEEITRALI | DSDVNFLWVI | KHKEEGKLPE | NLSEVIKTGK | GLIVAWCKQL | DVLAHESVGC | 840 |
| FVTHCGFNST | LEAISLGVPV | VAMPQFSDQT | TNAKLLDEIL | GVGVRVKADE | NGIVRRGNLA | 900 |
| SCIKMIMEEE | RGVIIRKNAV | KWKDLAKVAV | HEGGSSDNDI | VEFVSELIKA | | 950 |

SEQ ID NO: 133
Artificial Sequence

| | | | | | |
|---|---|---|---|---|---|
| atggctgaac | aacaaaagat | caagaagtct | ccacacgttt | tgttgattcc | atttccattg | 60 |
| caaggtcaca | tcaacccatt | cattcaattc | ggtaagagat | tgatttccaa | gggtgttaag | 120 |
| actactttgg | ttactaccat | ccataccttg | aactctacct | tgaaccattc | taacactacc | 180 |
| accacctcca | ttgaaattca | agctatttcc | gatggttgtg | atgaaggtgg | ttttatgtct | 240 |
| gctggtgaat | cttacttgga | aacctttaag | caagttggtt | ctaagtcctt | ggccgatttg | 300 |
| attaagaagt | tgcaatctga | aggtactacc | attgatgcca | ttatctacga | ttctatgacc | 360 |

TABLE 19-continued

Sequences disclosed herein.

```
gaatgggttt tggatgttgc tattgaattc ggtattgatg gtggttcatt cttcactcaa    420
gcttgtgttg ttaactcctt gtactaccat gttcacaagg gtttgatctc attgccattg    480
ggtgaaactg tttctgttcc aggtttccca gttttacaaa gatgggaaac tccattgatc    540
ttgcaaaacc acgaacaaat tcaatctcca tggtcccaaa tgttgtttgg tcaattcgcc    600
aacattgatc aagctagatg ggttttttacc aactccttct acaagttgga agaagaagtt    660
atcgaatgga ccagaaagat ctggaacttg aaagttattg gtccaacctt gccatctatg    720
tacttggata agagattgga tgacgataag gacaacggtt tcaacttgta caaggctaac    780
catcatgaat gcatgaattg gttggacgac aagccaaaag aatccgttgt ttatgttgct    840
ttcggttctt tggtcaaaca tggtccagaa caagttgaag aaattaccag agccttgatc    900
gattccgatg ttaatttctt gtgggtcatc aagcacaaag aagaaggtaa attgccagaa    960
aacttgtccg aagttatcaa aactggtaag ggtttgattg tcgcttggtg taaacaattg   1020
gatgttttgg ctcatgaatc cgttggttgt ttcgttactc attgtggttt caactccacc   1080
ttggaagcta tttctttggg tgttccagtt gttgctatgc cacaatttc tgatcaaact    1140
accaacgcta agttgttgga cgaaattttg ggtgttggtg ttagagttaa ggctgacgaa   1200
aatggtatcg ttagaagagg taacttggct tcttgcatca agatgatcat ggaagaagaa   1260
agaggtgtca tcattagaaa gaacgctgtt aagtggaagg atttggctaa agttgctgtt   1320
catgaaggtg gtagttccga taatgatatc gttgaattcg tttccgaatt gatcaaggcc   1380
agagcctcct ccaccaaact agtaaaaatg gatgctatgg ctaccaccga aaaaaagcca   1440
catgttattt tcattccatt cccagctcaa tcccatatta aggctatgtt gaagttggcc   1500
caattattgc atcacaaggg tttacaaatc accttcgtta acaccgactt catccacaat   1560
caattcttgg aatcttctgg tccacattgt ttggatggtg ctccaggttt tagatttgaa   1620
actattccag atggtgtttc ccattctcca gaagcttcta ttccaattag agaatccttg   1680
ttgagatcca tcgaaactaa tttcttggac agattcatcg acttggttac taagttgcca   1740
gatccaccaa cctgtattat ttctgatggt ttccttgtccg ttttcaccat tgatgctgct   1800
aagaaattgg gtatcccagt tatgatgtac tggactttgg ctgcttgtgg ttttatgggt   1860
ttctaccata tccattcctt gatcgaaaag ggttttgctc cattgaaaga tgcctcttac   1920
ttgactaacg gttacttgga taccgttatt gattgggttc caggtatgga aggtatcgaa   1980
ttgaaggatt tccattggaa ttggtccact gatttgaacg ataaggtttt gatgttcact   2040
accgaagctc cacaaagatc tcataaggtt tcccatcata tcttccacac cttcgatgaa   2100
ttggaaccat ccattattaa gaccttgtcc ttgagataca accacatcta taccattggt   2160
ccattgcaat tattattgga ccaaatccca gaagaaaaga gcaaactgga tattacttcc   2220
ttgcacggtt actcattggt caaagaagaa ccagaatgct tccaatggtt gcaatctaaa   2280
gaacctaact ccgttgtcta cgttaacttt ggttctacta ccgttatgtc cttggaagat   2340
atgactgaat tggttggggg tttggctaac tctaaccatt acttcttgtg gatcatcaga   2400
tccaacttgg ttattggtga aaacgctgtt ttgccaccag aattggaaga acatatcaag   2460
aagagaggtt tcattgcttc ttggtgttcc caagaaaagg ttttgaaaca tccatctgtc   2520
ggtggttttct tgactcattg tggttggggt tctaccattg aatctttgtc tgctggtgtt   2580
ccaatgattt gttggccata ttcttgggat caattgacca actgcagata catctgcaaa   2640
gaatgggaag tcggtttgga aatgggtaca aaagtcaaaa gagatgaagt caagagattg   2700
gtccaagaat tgatgggtga aggtggtcat aagtgaaga acaaagccaa ggactggaaa   2760
gaaaaggcta gaattgctat tgctccaaac ggttcttcct ctttgaacat tgacaagatg   2820
gtcaaagaaa tcaccgtttt ggccagaaac gtcgacctcg agtcatgtaa ttag         2874
```

SEQ ID NO: 134
Artificial Sequence
```
MAEQQKIKKS PHVLLIPFPL QGHINPFIQF GKRLISKGVK TTLVTTIHTL NSTLNHSNTT     60
TTSIEIQAIS DGCDEGGFMS AGESYLETFK QVGSKSLADL IKKLQSEGTT IDAIIYDSMT    120
EWVLDVAIEF GIDGGSFFTQ ACVVNSLYYH VHKGLISLPL GETVSVPGFP VLQRWETPLI    180
LQNHEQIQSP WSQMLFGQFA NIDQARWVFT NSFYKLEEEV IEWTRKIWNL KVIGPTLPSM    240
YLDKRLDDDK DNGFNLYKAN HHECMNWLDD KPKESVVYVA FGSLVKHGPE QVEEITRALI    300
DSDVNFLWVI KHKEEGKLPE NLSEVIKTGK GLIVAWCKQL DVLAHESVGC FVTHCGFNST    360
LEAISLGVPV VAMPQFSDQT TNAKLLDEIL GVGVRVKADE NGIVRRGNLA SCIKMIMEEE    420
RGVIIRKNAV KWKDLAKVAV HEGGSSDNDI VEFVSELIKA RASSTKLVKM DAMATTEKKP    480
HVIFIPPPAQ SHIKAMLKLA QLLHHKGLQI TFVNTDFIHN QFLESSGPHC LDGAPGRFE     540
TIPDGVSHSP EASIPIRESL LRSIETNFLD RFIDLVTKLP DPPTCIISDG FLSVFTIDAA    600
KKLGIPVMMY WTLAACGFMG FYHIHSLIEK GFAPLKDASY LTNGYLDTVI DWVPGMEGIR    660
LKDFPLDWST DLNDKVLMFT TEAPQRSHKV SHHIFHTFDE LEPSIIKTLS LRYNHIYTIG    720
PLQLLLDQIP EEKKQTGITS LHGYSLVKEE PECFQWLQSK EPNSVVYVNF GSTTVMSLED    780
MTEFGWGLAN SNHYFLWIIR SNLVIGENAV LPPELEEHIK KRGFIASWCS QEKVLKHPSV    840
GGFLTHCGWG STIESLSAGV PMICWPYSWD QLTNCRYICK EWEVGLEMGT KVKRDEVKRL    900
VQELMGEGGH KMRNKAKDWK EKARIAIAPN GSSSLNIDKM VKEITVLARN VDLESCN      957
```

SEQ ID NO: 135
Artificial Sequence
```
atggctgaac aacaaaagat caagaagtct ccacacgttt tgttgattcc atttccattg     60
caaggtcaca tcaacccatt cattcaattc ggtaagagat tgatttccaa gggtgttaag    120
actactttgg ttactaccat cccataccttg aactctacct tgaaccattc taacactacc   180
accacctcca ttgaaattca agctatttcc gatggttgtg atgaaggtgg tttttatgtct    240
gctggtgaat cttacttgga aacctttaag caagttggtt ctaagtcctt ggccgatttg    300
attaagaagt tgcaatctga aggtactacc attgatgcca ttatctacga ttctatgacc    360
gaatgggttt tggatgttgc tattgaattc ggtattgatg gtggttcatt cttcactcaa    420
gcttgtgttg ttaactcctt gtactaccat gttcacaagg gtttgatctc attgccattg    480
ggtgaaactg tttctgttcc aggtttccca gttttacaaa gatgggaaac tccattgatc    540
ttgcaaaacc acgaacaaat tcaatctcca tggtcccaaa tgttgtttgg tcaattcgcc    600
aacattgatc aagctagatg ggttttttacc aactccttct acaagttgga agaagaagtt    660
atcgaatgga ccagaaagat ctggaacttg aaagttattg gtccaacctt gccatctatg    720
tacttggata agagattgga tgacgataag gacaacggtt tcaacttgta caaggctaac    780
catcatgaat gcatgaattg gttggacgac aagccaaaag aatccgttgt ttatgttgct    840
```

TABLE 19-continued

Sequences disclosed herein.

```
ttcggttctt tggtcaaaca tggtccagaa caagttgaag aaattaccag agccttgatc    900
gattccgatg ttaatttctt gtgggtcatc aagcacaaga aagaaggtaa attgccagaa    960
aacttgtccg aagttatcaa aactggtaag ggtttgattg tcgcttggtg taaacaattg   1020
gatgttttgg ctcatgaatc cgttggttgt ttcgttactc attgtggttt caactccacc   1080
ttggaagcta tttctttggg tgttccagtt gttgctatgc cacaatttc tgatcaaact   1140
accaacgcta agttgttgga cgaaattttg ggtgttggtg ttagagttaa ggctgacgaa   1200
aatggtatcg ttagaagagg taacttggct tcttgcatca agatgatcat ggaagaagaa   1260
agaggtgtca tcattagaaa gaacgctgtt aagtggaagg atttggctaa agttgctgtt   1320
catgaaggtg gtagttccga taatgatatc gttgaattcg tttccgaatt gatcaaggcc   1380
aaactagtaa aaatggatgc tatgactacc accgaaaaaa agccacatgt tatttttcatt   1440
ccattcccag ctcaatccca tattaaggct atgttgaagt tggcccaatt attgcatcac   1500
aagggtttac aaatcacctt cgttaacacc gacttcatcc acaatcaatt cttgaatct   1560
tctggtccac attgcttgga tggtgctcca ggttttagat ttgaaactat tccagatggt   1620
gtttcccatt ctccagaagc ttctattcca attagagaat ccttgttgag atccatcgaa   1680
actaatttct tggacagatt catcgacttg gttactaagt tgccagatcc accaacctgt   1740
attatttctg atggtttctt gtccgttttc accattgatg ctgctaagaa attgggtatc   1800
ccagttatga tgtactggac tttggctgct tgtggttta tgggtttcta ccatatccat   1860
tccttgatcg aaaaggggtt tgctccattg aaagatgcct cttacttgac taacggttac   1920
ttggataccg ttattgattg ggttccaggt atggaaggta tcagattgaa ggattttcca   1980
ttggattggt ccactgattt gaacgataag gttttgatgt tcactaccga agctccacaa   2040
agatctcata aggtttccca tcatatcttc cacaccttcg atgaattgga accatccatt   2100
attaagacct tgtccttgag atacaaccac atctatacca ttggtccatt gcaattatta   2160
ttggaccaaa tcccagaaga aaagaagcaa actggtatta cttccttgca cggttactca   2220
ttggtcaaag aagaaccaga atgcttccaa tggttgcaat ctaaagaacc taactccgtt   2280
gtctacgtta actttggttc tactaccgtt atgtccttgg aagatatgac tgaatttggt   2340
tggggtttgg ctaactctaa ccattacttc ttgtggatca tcagatccaa cttggttatt   2400
ggtgaaaacg ctgttttgcc accagaattg gaagaacata tcaagaagag aggtttcatt   2460
gcttcttggt gttcccaaga aaaggttttg aaacatccat ctgtcggtgg tttcttgact   2520
cattgtggtt ggggttctac cattgaatct ttgtctgctg gtgttccaat gatttgttgg   2580
ccatattctt gggatcaatt gaccaactgc agatacatct gcaaagaatg ggaagtcggt   2640
ttggaaatgg gtacaaaagt caaaagagat gaagtcaaga gattggtcca agaattgatg   2700
ggtgaaggtg gtcataagat gagaaacaaa gccaaggact ggaaagaaaa ggctagaatt   2760
gctattgctc caaacggttc ttcctctttg aacattgaca agatggtcaa agaaatcacc   2820
gttttggcca gaaacgtcga cctcgagtca tgtaattag                           2859
```

SEQ ID NO: 136
Artificial Sequence

```
MAEQQKIKKS PHVLLIPFPL QGHINPFIQF GKRLISKGVK TTLVTTIHTL NSTLNHSNTT    60
TTSIEIQAIS DGCDEGGFMS AGESYLETFK QVGSKSLADL IKKLQSEGTT IDAIIYDSMT   120
EWVLDVAIEF GIDGGSFFTQ ACVVNSLYYH VHKGLISLEK GETVSVPGFP VLQRWETPLI   180
LQNHEQIQSP WSQMLFGQFA NIDQARWVFT NSFYKLEEEV IEWTRKIWNL KVIGPTLPSM   240
YLDKRLDDDK DNGFNLYKAN HHECMNWLDD KPKESVVYVA FGSLVKHGPE QVEEITRALI   300
DSDVNFLWVI KHKEEGKLPE NLSEVIKTGK GLIVAWCKQL DVLAHESVGC FVTHCGFNST   360
LEAISLGVPV VAMPQFSDQT TNAKLLDEIL GVGVRVKADE NGIVRRGNLA SCIKMIMEEE   420
RGVIIRKNAV KWKDLAKVAV HEGGSSDNDI VEFVSELIKA KLVKMDAMAT TEKKPHVIFI   480
PFPAQSHIKA MLKLAQLLHH KGLQITFVNT DFIHNQFLES SGPHCLDGAP GFRFETIPDG   540
VSHSPEASIP IRESLLRSIE TNFLDRFIDL VTKLPDPPTC IISDGFLSVF TIDAAKKLGI   600
PVMMYWTLAA CGFMGFYHIH SLIEKGFAPL KDASYLTNGY LDTVIDWVPG MEGIRLKDFP   660
LDWSTDLNDK VLMFTTEAPQ RSHKVSHHIF HTFDELEPSI IKTLSLRYNH IYTIGPLQLL   720
LDQIPEEKKQ TGITSLHGYS LVKEEPECFQ WLQSKEPNSV VYVNFGSTTV MSLEDMTEFG   780
WGLANSNHYF LWIIRSNLVI GENAVLPPEL EEHIKKRGFI ASWCSQEKVL KHPSVGGFLT   840
HCGWGSTIES LSAGVPMICW PYSWDQLTNC RYICKEWEVG LEMGTKVKRD EVKRLVQELM   900
GEGGHKMRNK AKDWKEKARI AIAPNGSSSL NIDKMVKEIT VLARNVDLES CN           952
```

SEQ ID NO: 137
Artificial Sequence

```
atggatgcta tggctaccac cgaaaaaaag ccacatgtta tttcattcc attcccagct     60
caatcccata ttaaggctat gttgaagttg gcccaattat tgcatcacaa gggtttacaa    120
atcaccttcg ttaacaccga cttcatccac aatcaattct ggaatcttc tggtccacat    180
tgcttggatg gtgctccagg ttttagattt gaaactattc cagatggtgt ttcccattct    240
ccagaagctt ctattccaat tagagaatcc ttgttgagat ccatcgaaac taatttcttg    300
gacagattca tcgacttggt tactaagttg ccagatccac caacctgtat tatttctgat    360
ggtttcttgt ccgttttcac cattgatgct gctaagaat gggtatccc agttatgatg    420
tactggactt tggctgcttg tggtttatg ggtttctacc atatccattc cttgatcgaa    480
aagggttttg ctccattgaa agatgcctct tacttgacta acggttactt ggataccgtt    540
attgattggg ttccaggtat ggaaggtatc agattgaagg attttccatt ggattggtcc    600
actgatttga acgataaggt tttgatgttc actaccgaag ctccacaaag atctcataag    660
gtttcccatc atatcttcca caccttcgat gaattggaac catccattat taagaccttg    720
tccttgagat acaaccacat ctataccatt ggtccattgc aattattagg accaaatc     780
ccagaagaaa agaagcaaac tggtattact tccttgcacg gttactcatt ggtcaaagaa    840
gaaccagaat gcttccaatg gttgcaatct aaagaaccta ctccgttgt ctacgttaac    900
tttggttcta ctaccgttat gtccttggaa gatatgactg aatttggttg gggtttggct    960
aactctaacc attacttctt gtggatcatc agatccaact tggttattgg tgaaaacgct   1020
gttttgccac cagaattgga agaacatatc aagaagagag gtttcattgc ttcttggtgt   1080
tcccaagaaa aggttttgaa acatccatct gtcggtggtt tcttgactca ttgtggttgg   1140
ggttctacca ttgaatcttt gtctgctggt gttccaatga tttgttggcc atattcttgg   1200
gatcaattga ccaactgcag atacatctgc aaagaatggg aagtcggttt ggaaatgggt   1260
acaaaagtca aaagagatga agtcaagaga ttggtccaag aattgatggg tgaaggtggt   1320
```

TABLE 19-continued

Sequences disclosed herein.

```
cataagatga gaaacaaagc caaggactgg aagaaaagg ctagaattgc tattgctcca    1380
aacggttctt cctctttgaa cattgacaag atggtcaaag aaatcaccgt tttggccaga   1440
aacggtggag gaggctctg tggaggcggt agcggaggcg gagggtcgat ggctgaacaa    1500
caaaagatca agaagtctcc acacgttttg ttgattccat ttccattgca aggtcacatc   1560
aacccattca ttcaattcgg taagagattg atttccaagg gtgttaagac tactttggtt   1620
actaccatcc ataccttgaa ctctaccttg aaccattcta acactaccac cacctccatt   1680
gaaattcaag ctatttccga tggttgtgat gaaggtggtt ttatgtctgc tggtgaatct   1740
tacttggaaa cctttaagca agttggttct aagtccttgg ccgatttgat taagaagttg   1800
caatctgaag gtactaccat tgatgccatt atctacgatt ctatgaccga atgggttttg   1860
gatgttgcta ttgaattcgg tattgatggt ggttcattct tcactcaagc ttgtgttgtt   1920
aactccttgt actaccatgt tcacaagggt ttgatctcat tgccattggg tgaaactgtt   1980
tctgttccag gtttcccagt tttacaaaga tgggaaactc cattgatctt gcaaaaccac   2040
gaacaaattc aatctccatg gtcccaaatg ttgtttggtc aattcgccaa cattgatcaa   2100
gctagatggg ttttaccaa ctccttctac aagttggaag aagaagttat cgaatggacc   2160
agaaagatct ggaacttgaa agttattggt ccaaccttgc catctatga cttggataag   2220
agattggatg acgataagga caacggtttc aacttgtaca aggctaacca tcatgaatgc   2280
atgaattggt tggacgacaa gccaaaagaa tccgttgttt atgttgcttt cggttctttg   2340
gtcaaacatg gtccagaaca agttgaagaa attaccagag ccttgatcga ttccgatgtt   2400
aatttcttgt gggtcatcaa gcacaaagaa gaagttaaat tgccagaaaa cttgtccgaa   2460
gttatcaaaa ctggtaaggg tttgattgtc gcttggtgta aacaattgga tgttttggct   2520
catgaatccg ttggttgttt cgttactcat tgtggtttca actccacctt ggaagctatt   2580
tctttgggtg ttccagttgt tgctatgcca caattttctg atcaaactac caacgctaag   2640
ttgttggaca aaattttggg tggtgttt agagttaagg ctgacgaaaa tggtatcgtt   2700
agaagaggta acttggcttc ttgcatcaag atgatcatgg aagaagaaag aggtgtcatc   2760
attagaaaga acgctgttaa gtggaaggat ttggctaaag ttgctgttca tgaaggtggt   2820
agttccgata tgatatcgt tgaattcgtt ccgaattga tcaaggccta a              2871
```

SEQ ID NO: 138
Artificial Sequence

```
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYIHISLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
NGGGGSGGGG SGGGGSMAEQ QKIKKSPHVL LIPPPLQGHI NPPIQFGKRL ISKGVKTTLV   540
TTIHTLNSTL NHSNTTTTSI EIQAISDGCD EGGFMSAGES YLETFKQVGS KSLADLIKKL   600
QSEGTTIDAI IYDSMTEWVL DVAIEFGIDG GSFFTQACVV NSLYYHVHKG LISLPLGETV   660
SVPGFPVLQR WETPLILQNH EQIQSPWSQM LFGQFANIDQ ARWVFTNSFY KLEEEVIEWT   720
RKIWNLKVIG PTLPSMYLDK RLDDDKDNGF NLYKANHHEC MNWLDDKPKE SVVYVAFGSL   780
VKHGPEQVEE ITRALIDSDV NFLWVIKHKE EGKLPENLSE VIKTGKGLIV AWCKQLDVLA   840
HESVGCFVTH CGFNSTLEAI SLGVPVVAMP QFSDQTTNAK LLDEILGVGV RVKADENGIV   900
RRGNLASCIK MIMEEERGVI IRKNAVKWKD LAKVAVHEGG SSDNDIVEFV SELIKA        956
```

SEQ ID NO: 139
Artificial Sequence

```
atggatgcta tggctaccac cgaaaaaaag ccacatgtta ttttcattcc attcccagct     60
caatcccata ttaaggctat gttgaagttg gcccaattat tgcatcacaa gggtttacaa    120
atcaccttcg ttaacaccga cttcatccac aatcaattct ggaatcttc tggtccacat    180
tgcttggatg gtgctccagg ttttagattt gaaactattc cagatggtgt ttcccattct    240
ccagaagctt ctattccaat tagagaatcc ttgttgagat ccatcgaaac taatttcttg    300
gacagattca tcgactggt tactaagttg ccagatccac caacctgtat tatttctgat    360
ggtttcttgt ccgttttcac cattgatgct gctaagaaat tgggtatccc agttatgatg    420
tactggactt tggctgcttg tggttttatg ggtttctacc atatccattc cttgatcgaa    480
aagggttttg ctccattgaa agatgcctct tacttgacta acggttactt ggataccgtt    540
attgattggg ttccaggtat ggaaggtatc agattgaagg attttccatt ggattggtcc    600
actgatttga cgataaggt tttgatgttc actaccgaag ctccacaaag atctcataag    660
gtttcccatc atatcttcca caccttcgat gaattggaac catccattat taagaccttg    720
tccttgagat acaaccacat ctataccatt ggtccattgc aattattatt ggaccaaatc    780
ccagaagaaa agaagcaaac tggtattact tccttgcacg gttactcatt ggtcaaagaa   840
gaaccagaat gcttccaatg gttgcaatct aagaaccta actccgttgt ctacgttaac    900
tttggttcta ctaccgttat gtccttggaa gatatgactg aatttggttg gggttttggct   960
aactctaacc attacttctt gtggatcatc agatccaact tggttattgg tgaaaacgct   1020
gttttgccac cagaattgga agaacatatc aagaagagag gtttcattgc ttcttggtgt   1080
tcccaagaaa aggttttgaa acatccatct gtcggtggtt tcttgactca ttgtggttgg   1140
ggttctacca ttgaatcttt gtctgctggt gttccaatga tttgttggcc atattcttgg   1200
gatcaattga ccaactgcag atacatctgc aaagaatggg aatcggttt ggaaatggtt   1260
acaaaagtca aaagagatga agtcaagaga ttggtccaag aattgatggg tgaaggtggt   1320
cataagatga gaaacaaagc caaggactgg aagaaaagg ctagaattgc tattgctcca   1380
aacggttctt cctctttgaa cattgacaag atggtcaaag aaatcaccgt tttggccaga   1440
aacggtggag gaggctctat ggctgaacaa caaaagatca agaagtctcc acacgttttg   1500
ttgattccat ttccattgca aggtcacatc aacccattca ttcaattcgg taagagattg   1560
atttccaagg gtgttaagac tactttggtt actaccatcc ataccttgaa ctctaccttg   1620
aaccattcta acactaccac cacctccatt gaaattcaag ctatttccga tggttgtgat   1680
gaaggtggtt ttatgtctgc tggtgaatct tacttggaaa cctttaagca agttggttct   1740
aagtccttgg ccgatttgat taagaagttg caatctgaag gtactaccat tgatgccatt   1800
```

TABLE 19-continued

Sequences disclosed herein.

```
atctacgatt ctatgaccga atgggttttg gatgttgcta ttgaattcgg tattgatggt   1860
ggttcattct tcactcaagc ttgtgttgtt aactccttgt actaccatgt tcacaagggt   1920
ttgatctcat tgccattggg tgaaactgtt tctgttccag gtttcccagt tttacaaaga   1980
tgggaaactc cattgatctt gcaaaaccac gaacaaattc aatctccatg gtcccaaatg   2040
ttgtttggtc aattcgccaa cattgatcaa gctagatggg tttttaccaa ctccttctac   2100
aagttggaag aagaagttat cgaatggacc agaaagatct ggaacttgaa agttattggt   2160
ccaaccttgc catctatgta cttggataag agattggatg acgataagga caacggtttc   2220
aacttgtaca aggctaacca tcatgaatgc atgaattggt tggacgacaa gccaaaagaa   2280
tccgttgttt atgttgcttt cggttctttg gtcaaacatg gtccagaaca agttgaagaa   2340
attaccagag ccttgatcga ttccgatgtt aatttcttgt gggtcatcaa gcacaaagaa   2400
gaaggtaaat tgccagaaaa ccttgtccgaa gttatcaaaa ctggtaaggg tttgattgtc   2460
gcttggtgta aacaattgga tgttttggct catgaatccg ttggttgttt cgttactcat   2520
tgtggtttca actccacctt ggaagctatt tctttgggtg ttccagttgt tgctatgcca   2580
caattttctg atcaaactac caacgctaag ttgttggacg aaattttggg tgttggtgtt   2640
agagttaagg ctgacgaaaa tggtatcgtt agaagagta acttggcttc ttgcatcaag   2700
atgatcatgg aagaagaaag aggtgtcatc attagaaaag acgctgttaa gtggaaggat   2760
ttggctaaag ttgctgttca tgaaggtggt agttccgata tgatatcgt tgaattcgtt   2820
tccgaattga tcaaggccta a                                             2841
```

SEQ ID NO: 140
Artificial Sequence

```
MDAMATTEKK PHVIFIPFPA QSHIKAMLKL AQLLHHKGLQ ITFVNTDFIH NQFLESSGPH    60
CLDGAPGFRF ETIPDGVSHS PEASIPIRES LLRSIETNFL DRFIDLVTKL PDPPTCIISD   120
GFLSVFTIDA AKKLGIPVMM YWTLAACGFM GFYIHSLIE KGFAPLKDAS YLTNGYLDTV   180
IDWVPGMEGI RLKDFPLDWS TDLNDKVLMF TTEAPQRSHK VSHHIFHTFD ELEPSIIKTL   240
SLRYNHIYTI GPLQLLLDQI PEEKKQTGIT SLHGYSLVKE EPECFQWLQS KEPNSVVYVN   300
FGSTTVMSLE DMTEFGWGLA NSNHYFLWII RSNLVIGENA VLPPELEEHI KKRGFIASWC   360
SQEKVLKHPS VGGFLTHCGW GSTIESLSAG VPMICWPYSW DQLTNCRYIC KEWEVGLEMG   420
TKVKRDEVKR LVQELMGEGG HKMRNKAKDW KEKARIAIAP NGSSSLNIDK MVKEITVLAR   480
NGGGGSMAEQ QKIKKSPHVL LIPFPLQGHI NPFIQFGKRL ISKGVKTTLV TTIHTLNSTL   540
NHSNTTTTSI EIQAISDGCD EGGFMSAGES YLETFKQVGS KSLADLIKKL QSEGTTIDAI   600
IYDSMTEWVL DVAIEFGIDG GSFFTQACVV NSLYYHVHKG LISLPLGETV SVPGFPVLQR   660
WETPLILQNH EQIQSPWSQM LFGQFANIDQ ARWVFTNSFY KLEEEVIEWT RKIWNLKVIG   720
PTLPSMYLDK RLDDDKDNGF NLYKANHHEC MNWLDDKPKE SVVYVAFGSL VKHGPEQVEE   780
ITRALIDSDV NFLWVIKHKE EGKLPENLSE VIKTGKGLIV AWCKQLDVLA HESVGCFVTH   840
CGFNSTLEAI SLGVPVVAMP QFSDQTTNAK LLDEILGVGV RVKADENGIV RRGNLASCIK   900
MIMEEERGVI IRKNAVKWKD LAKVAVHEGG SSDNDIVEFV SELIKA                 946
```

SEQ ID NO: 141
Artificial Sequence

```
atggatgcta tggctaccac cgaaaaaaag ccacatgtta ttttcattcc attcccagct    60
caatcccata ttaaggctat gttgaagttg gcccaattat tgcatcacaa gggtttacaa   120
atcaccttcg ttaacaccga cttcatccac aatcaattct ggaatcttc tggtccacat   180
tgcttggatg gtgctccagg ttttagattt gaaactattc cagatggtgt ttcccattct   240
ccagaagctt ctattccaat tagagaatcc ttgttgagat ccatcgaaac taatttcttg   300
gacagattca tcgacttggt tactaagttg ccagatccac caacctgtat tatttctgat   360
ggtttcttgt ccgttttcac cattgatgct gctaagaat ggg tatccc agttatgatg   420
tactggactt tggctgcttg tggttttatg gtttctacc atatccattc cttgatcgaa   480
aagggttttg ctccattgaa agatgcctct tacttgacta acggttactt ggataccgtt   540
attgattggg ttccaggtat ggaaggtatc agattgaagg attttccatt ggattggtcc   600
actgatttga acgataaggt tttgatgttc actaccgaag ctccacaaag atctcataag   660
gtttcccatc atatcttcca caccttcgat gaattggaac catccattat taagaccttg   720
tccttgagat acaaccacat ctataccatt ggtccattgc aattattatt ggaccaaatc   780
ccagaagaaa agaagcaaac tggtattact tccttgcacg gttactcatt ggtcaaagaa   840
gaaccagaat gcttccaatg gttgcaatct aagaaccta actccgttgt ctacgttaac   900
tttggttcta ctaccgttat gtccttggaa gatatgactg aatttggttg gggttttggct   960
aactctaacc attacttctt gtggatcatc agatccaact tggttattgg tgaaaacgct  1020
gttttgccac cagaattgga agaacatatc aagaagagag gtttcattgc ttcttggtgt  1080
tcccaagaaa aggttttgaa acatccatct gtcggtggtt tcttgactca ttgtggttgg  1140
ggttctacca ttgaatcttt gtctgctggt gttccaatga tttgttggcc atattcttgg  1200
gatcaattga ccaactgcag atacatctgc aaagaatgga agtcggttg ggaaatggt   1260
acaaaagtca aaagagatga agtcaagaga ttggtccaag aattgatggg tgaaggtggt  1320
cataagatga gaaacaaagc caaggactgg aagaaaagg ctagaattgc tattgctcca  1380
aacggttctt cctctttgaa cattgacaag atggtcaaag aaatcaccgt tttggccaga  1440
aacatggctg aacaacaaaa gatcaagaag tctccacaag tttttgttgat tccattcca   1500
ttgcaaggtc acatcaaccc attcattcaa ttcggtaaga gattgatttc caagggtgtt  1560
aagactactt tggttactac catccatacc ttgaactcta ccttgaacca ttctaacact  1620
accaccacct ccattgaaat tcaagctatt ccgatggtt gtgatgaagg tggttttatg   1680
tctgctggtg aatcttactt ggaaacttt aagcaagttg gttctaagtc cttggccgat   1740
ttgattaaga agttgcaatc tgaaggtact accattgatg ccattatcta cgattctatg   1800
accgaatggg ttttggatgt tgctattgaa ttcggtattg atggtggttc attcttcact   1860
caagcttgtg ttgttaactc cttgtactac catgttcaca agggtttgat ctcattgcca   1920
ttgggtgaaa ctgtttctgt tccaggtttc ccagtttac aaagatggga aactccattg  1980
atcttgcaaa accacgaaca aattcaatct ccatggtccc aaatgttgtt tggtcaattc   2040
gccaacattg atcaagctag atgggttttt accaactcct ctacaagtt ggaagaagaa   2100
gttatcgaat ggaccagaaa gatctggaac ttgaaagtta ttggtccaac cttgccatct  2160
atgtacttgg ataagagatt ggatgacgat aaggacaacg gtttcaactt gtacaaggct  2220
aaccatcatg aatgcatgaa ttggttggac gacaagccaa agaatccgt tgtttatgtt  2280
```

TABLE 19-continued

Sequences disclosed herein.

```
gctttcggtt ctttggtcaa acatggtcca gaacaagttg aagaaattac cagagccttg   2340
atcgattccg atgttaattt cttgtgggtc atcaagcaca aagaagaagg taaattgcca   2400
gaaaacttgt ccgaagttat caaaactggt aagggtttga ttgtcgcttg gtgtaaacaa   2460
ttggatgttt tggctcatga atccgttggt tgtttcgtta ctcattgtgg tttcaactcc   2520
accttggaag ctatttcttt gggtgttcca gttgttgcta tgccacaatt ttctgatcaa   2580
actaccaacg ctaagttgtt ggacgaaatt ttgggtgttg gtgttagagt taaggctgac   2640
gaaaatggta tcgttagaag aggtaacttg gcttcttgca tcaagatgat catggaagaa   2700
gaaagaggtg tcatcattag aaagaacgct gttaagtgga aggatttggc taaagttgct   2760
gttcatgaag gtggtagttc cgataatgat atcgttgaat cgtttccga attgatcaag   2820
gcctaa                                                               2826

SEQ ID NO: 142
Artificial Sequence
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
NMAEQQKIKK SPHVLLIPFP LQGHINPFIQ FGKRLISKGV KTTLVTTIHT LNSTLNHSNT    540
TTTSIEIQAI SDGCDEGGFM SAGESYLETF KQVGSKSLAD LIKKLQSEGT TIDAIIYDSM    600
TEWVLDVAIE FGIDGGSFFT QACVVNSLYY HVHKGLISLP LGETVSVPGF PVLQRWETPL    660
ILQNHEQIQS PWSQMLFGQF ANIDQARWVF TNSFYKLEEE VIEWTRKIWN LKVIGPTLPS    720
MYLDKRLDDD KDNGFNLYKA NHHECMNWLD DKPKESVVYV AFGSLVKHGP EQVEEITRAL    780
IDSDVNFLWV IKHKEEGKLP ENLSEVIKTG KGLIVAWCKQ LDVLAHESVG CFVTHCGFNS    840
TLEAISLGVP VVAMPQFSDQ TTNAKLLDEI LGVGVRVKAD ENGIVRRGNL ASCIKMIMEE    900
ERGVIIRKNA VKWKDLAKVA VHEGGSSDND IVEFVSELIK A                        941

SEQ ID NO: 143
Artificial Sequence
atggctgaac aacaaaagat caagaagtct ccacacgttt tgttgattcc atttccattg     60
caaggtcaca tcaacccatt cattcaattc ggtaagagat tgatttccaa gggtgttaag    120
actactttgg ttactaccat ccataccttg aactctacct tgaaccattc taacactacc    180
accacctcca ttgaaattca agctatttcc gatggttgtg atgaaggtgg ttttatgtct    240
gctggtgaat cttacttgga aacctttaag caagttggtt ctaagtcctt ggccgatttg    300
attaagaagt tgcaatctga aggtactacc attgatgcca ttatctacga ttctatgacc    360
gaatgggttt tggatgttgc tattgaattc ggtattgatg gtggttcatt cttcactcaa    420
gcttgtgttg ttaactcctt gtactaccat gttcacaagg gtttgatctc attgccattg    480
ggtgaaactg tttctgttcc aggtttccca gttttacaaa gatgggaaac tccattgatc    540
ttgcaaaacc acgaacaaat tcaatctcca tggtcccaaa tgttgtttgg tcaattcgcc    600
aacattgatc aagctagatg ggttttttacc aactccttct acaagttgga agaagaagtt    660
atcgaatgga ccagaaagat ctggaacttg aaagttattg gtccaaacctt gccatctatg    720
tacttggata agagattgga tgacgataag gacaacggtt tcaacttgta caaggctaac    780
catcatgaat gcatgaattg gttggacgac aagccaaaag aatccgttgt ttatgttgct    840
ttcggttctt tggtcaaaca tggtccagaa caagttgaag aaattaccag agccttgatc    900
gattccgatg ttaatttctt gtgggtcatc agcacaagaa agaaggtaa attgccagaa    960
aacttgtccg aagttatcaa aactggtaag ggtttgattg tcgcttggtg taaacaattg   1020
gatgttttgg ctcatgaatc cgttggttgt tcgttactc attgtggttt caactccacc   1080
ttggaagcta tttctttggg tgttccagtt gttgctatgc cacaattttc tgatcaaact   1140
accaacgcta agttgttgga cgaaattttg ggtgttggtg ttagagttaa ggctgacgaa   1200
aatggtatcg ttagaagagg taacttggct tcttgcatca agatgatcat ggaagaagaa   1260
agaggtgtca tcattagaaa gaacgctgtt aagtggaagg atttggctaa agttgctgtt   1320
catgaaggtg gtagttccga taatgatatc gttgaattcg tttccgaatt gatcaaggcc   1380
ggtggaggag gctctggtgg aggcggtagc ggaggcggag gtcgatgga tgctatggct   1440
accaccgaaa aaagccaca tgttattttc attccattcc cagctcaatc ccatattaag   1500
gctatgttga agttggccca attattgcat cacaagggtt tacaaatcac cttcgttaac   1560
accgacttca tccacaatca attcttgaa tcttctggtc acattgctt ggatggtgct    1620
ccaggtttta gatttgaaac tattccagat ggtgtttccc attctccaga agcttctatt   1680
ccaattagag aatccttgtt gagatccatc gaaactaatt tcttggacag attcatcgac   1740
ttggttacta agttgccaga tccaccaacc tgtattattt ctgatggttt cttgtccgtt   1800
ttcaccattg atgctgctaa gaaattgggg atcccagtta tgatgactg gacttggct    1860
gcttgtggtt ttatgggtttt ctaccatatc cattccttga tcgaaagggg ttttgctcca   1920
tgaaagatg cctcttactt gactaacggt tacttgtaca ccgttattga ttgggttcca   1980
ggtatggaag gtatcagatt gaaggatttt ccattggatt ggtccactga tttgaacgat   2040
aaggttttga tgttcactac cgaagctcca caaagatctc ataaggtttc ccatcatatc   2100
ttccacacct tcgatgaatt ggaaccatcc attattaaga ccttgtcctt gagatacaac   2160
cacatctata ccattggtcc attgcaatta ttattggacc aaatcccaga agaaaagaag   2220
caaactggta ttacttcctt gcacggttac tcattggtca agaagaacc agaatgcttc   2280
caatggttgc aatctaaaga acctaactgt gttgtctacg ttaactttgg ttctactacc   2340
gttatgtcct tggaagatat gactgaattt ggttggggtt tggctaactc taaccattac   2400
ttcttgtgga tcatcagatc caacttggtt attggtgaaa acgctgtttt gccaccagaa   2460
ttggaagaac atatcaagaa gagaggtttc attgcttctt ggtgttccca agaaaaggtt   2520
ttgaaacatc catctgtcgg tggttcttg actcattgtg gttggggttc taccattgaa   2580
tctttgtctg ctggtgttcc aatgatttgt tggccatatt cttgggatca attgaccaac   2640
tgcagataca tctgcaaaga atgggaagtc ggtttgaaa tgggtacaaa agtcaaaaga   2700
gatgaagtca agagattggt ccaagaattg atgggtaagg tggtcataa gatgagaaac   2760
```

TABLE 19-continued

Sequences disclosed herein.

```
aaagccaagg actggaaaga aaaggctaga attgctattg ctccaaacgg ttcttcctct   2820
ttgaacattg acaagatggt caaagaaatc accgttttgg ccagaaactg a            2871

SEQ ID NO: 144
Artificial Sequence
MAEQQKIKKS PHVLLIPFPL QGHINPFIQF GKRLISKGVK TTLVTTIHTL NSTLNHSNTT    60
TTSIEIQAIS DGCDEGGFMS AGESYLETFK QVGSKSLADL IKKLQSEGTT IDAIIYDSMT   120
EWVLDVAIEF GIDGGSFFTQ ACVVNSLYYH VHKGLISLPL GETVSVPGFP VLQRWETPLI   180
LQNHEQIQSP WSQMLFGQFA NIDQARWVFT NSFYKLEEEV IEWTRKIWNL KVIGPTLPSM   240
YLDKRLDDDK DNGFNLYKAN HHECMNWLDD KPKESVVYVA FGSLVKHGPE QVEEITRALI   300
DSDVNFLWVI KHKEEGKLPE NLSEVIKTGK GLIVAWCKQL DVLAHESVGC FVTHCGFNST   360
LEAISLGVPV VAMPQFSDQT TNAKLLDEIL GVGVRVKADE NGIVRRGNLA SCIKMIMEEE   420
RGVIIRKNAV KWKDLAKVAV HEGGSSDNDI VEFVSELIKA GGGGSGGGGS GGGGSMDAMA   480
TTEKKPHVIF IPFPAQSHIK AMLKLAQLLH HKGLQITFVN TDFIHNQFLE SSGPHCLDGA   540
PGFRFETIPD GVSHSPEASI PIRESLLRSI ETNFLDRFID LVTKLPDPPT CIISDGFLSV   600
FTIDAAKKLG IPVMMYWTLA ACGFMGFYHI HSLIEKGFAP LKDASYLTNG YLDTVIDWVP   660
GMEGIRLKDF PLDWSTDLND KVLMFTTEAP QRSHKVSHHI FHTFDELEPS IIKTLSLRYN   720
HIYTIGPLQL LLDQIPEEKK QTGITSLHGY SLVKEEPECF QWLQSKEPNS VVYVNFGSTT   780
VMSLEDMTEF GWGLANSNHY FLWIIRSNLV IGENAVLPPE LEEHIKKRGF IASWCSQEKV   840
LKHPSVGGFL THCGWGSTIE SLSAGVPMIC WPYSWDQLTN CRYICKEWEV GLEMGTKVKR   900
DEVKRLVQEL MGEGGHKMRN KAKDWKEKAR IAIAPNGSSS LNIDKMVKEI TVLARN       956

SEQ ID NO: 145
Artificial Sequence
atggctgaac aacaaaagat caagaagtct ccacacgttt tgttgattcc atttccattg    60
caaggtcaca tcaacccatt cattcaattc ggtaagagat tgatttccaa gggtgttaag   120
actactttgg ttactaccat ccataccttg aactctacct tgaaccattc taacactacc   180
accacctcca ttgaaattca agctatttcc gatggttgtg atgaaggtgg ttttatgtct   240
gctggtgaat cttacttgga aacctttaag caagttggtt ctaagtcctt ggccgatttg   300
attaagaagt tgcaatctga aggtactacc attgatgcca ttatctacga ttctatgacc   360
gaatgggttt tggatgttgc tattgaattc ggtattgatg gtggttcatt cttcactcaa   420
gcttgtgttg ttaactcctt gtactaccat gttcacaagg tttgatctc attgccattg   480
ggtgaaactg tttctgttcc aggtttccca gttttacaaa gatgggaaac tccattgatc   540
ttgcaaaacc acgaacaaat tcaatctcca tggtcccaaa tgtttgttgg tcaattcgcc   600
aacattgatc aagctagatg ggttttttacc aactccttct acaagttgga agaagaagtt   660
atcgaatgga ccagaaagat ctggaacttg aagttgtc caaccttt gccatctatg   720
tacttggata agagattgga tgacgataag gacaacggtt tcaacttgta caaggctaac   780
catcatgaat gcatgaattg gttggacgac aagccaaaag aatccgttgt ttatgttgct   840
ttcggttctt tggtcaaaca tggtccagaa caagttgaag aaattaccag agccttgatc   900
gattccgatg ttaatttctt gtgggtcatc agcacaaag aagaaggtaa attgccagaa   960
aacttgtccg aagttatcaa aactggtaag ggttttgattg tcgcttggtg taaacaattg  1020
gatgttttgg ctcatgaatc cgttggttgt ttcgttactc attgtggttt caactccacc  1080
ttggaagcta tttctttggg tgttccagtt gttgctatgc cacaatttc tgatcaaact  1140
accaacgtca agttgttgga cgaaattttg ggtgttggtg ttagagttaa ggctgacgaa  1200
aatggtatcg ttagaagagg taacttggct tcttgcatca agatgatcat ggaagaagaa  1260
agaggtgtca tcattagaaa aacgctgttt aagtggaagg atttggctaa agttgctgtt  1320
catgaaggtg gtagttccga taatgatatc gttgaattcg tttccgaatt gatcaaggcc  1380
ggtggaggag gctcatgga tgctatggct accaccgaaa aaaagccaca tgttatttc  1440
attccattcc cagctcaatc ccatattaag gctatgttga agttggccca attattgcat  1500
cacaagggtt tacaaatcac cttcgttaac accgacttca tccacaatca attcttggaa  1560
tcttctggtc cacattgctt ggatggtgct ccaggtttta gatttgaaac tattccagat  1620
ggtgtttccc attctccaga agcttctatt ccaattagag aatccttgtt gagatccatt  1680
gaaactaatt tcttggacag attcatcgac ttggttacta agttgccaga tccaccaacc  1740
tgtattattt ctgatggttt cttgtccgtt tcaccattg atgctgctaa gaaattgggt  1800
atcccagtta tgatgtactg gactttggct gcttgtggtt tatgggttt ctaccatatc  1860
cattccttga tcgaaaaggg ttttgctcca ttgaagatg cctcttactt gactaacggt  1920
tacttggata ccgttattga ttgggttcca ggtatgaag gtatcagatt gaaggattt  1980
ccattggatt ggtccactga tttgaacgat aaggttttga tgttcactac cgaagctcca  2040
caaagatctc ataaggtttc catcatatc tccacacct tcgatgaatt ggaaccatcc  2100
attattaaga ccttgtcctt gagatacaac cacatctata ccattggtcc attgcaatta  2160
ttattggacc aaatcccaga agaaaagaag caaactggtta ttacttcctt gcacggttac  2220
tcattggtca agaagaaacc agaatgcttc caatggttgc aatctaaaga acctaactcc  2280
gttgtctacg ttaactttgg ttctactacc gttatgtcct tggaagatat gactgaattt  2340
ggttgggggtt tggctaactc taaccattac ttcttgtgga tcatcagatc caacttggtt  2400
attggtgaaa acgctgtttt gccaccagaa ttggaagaac atatcaagaa gagaggtttc  2460
attgcttctt ggtgttccca agaaaaggtt ttgaaacatc catctgtcgg tggtttcttg  2520
actcattgtg gttgggggttc taccattgaa tctttgtctg ctggtgttcc aatgatttgt  2580
tggccatatt cttgggatca attgaccaac tgcagataca tctgcaaaga atgggaagtc  2640
ggtttggaaa tgggtacaaa agtcaaaaga gatgaagtca agagattggt ccaagaattg  2700
atgggtgaag tggtcataaa gatgagaaac aaagccaagg actggaaaga aaaggctaga  2760
attgctattg ctccaaacgg ttcttcctct ttgaacattg acaagatggt caaagaaatc  2820
accgttttgg ccagaaactg a                                            2841

SEQ ID NO: 146
Artificial Sequence
MAEQQKIKKS PHVLLIPFPL QGHINPFIQF GKRLISKGVK TTLVTTIHTL NSTLNHSNTT    60
TTSIEIQAIS DGCDEGGFMS AGESYLETFK QVGSKSLADL IKKLQSEGTT IDAIIYDSMT   120
EWVLDVAIEF GIDGGSFFTQ ACVVNSLYYH VHKGLISLPL GETVSVPGFP VLQRWETPLI   180
```

TABLE 19-continued

Sequences disclosed herein.

```
LQNHEQIQSP WSQMLFGQFA NIDQARWVFT NSFYKLEEEV IEWTRKIWNL KVIGPTLPSM    240
YLDKRLDDDK DNGFNLYKAN HHECMNWLDD KPKESVVYVA FGSLVKHGPE QVEEITRALI    300
DSDVNFLWVI KHKEEGKLPE NLSEVIKTGK GLIVAWCKQL DVLAHESVGC FVTHCGFNST    360
LEAISLGVPV VAMPQFSDQT TNAKLLDEIL GVGVRVKADE NGIVRRGNLA SCIKMIMEEE    420
RGVIIRKNAV KWKDLAKVAV HEGGSSDNDI VEFVSELIKA GGGGSMDAMA TTEKKPHVIF    480
IPFPAQSHIK AMLKLAQLLH HKGLQITFVN TDFIHNQFLE SSGPHCLDGA PGFRFETIPD    540
GVSHSPEASI PIRESLLRSI ETNFLDRFID LVTKLPDPPT CIISDGFLSV FTIDAAKKLG    600
IPVMMYWTLA ACGFMGFYHI HSLIEKGFAP LKDASYLTNG YLDTVIDWVP GMEGIRLKDF    660
PLDWSTDLND KVLMFTTEAP QRSHKVSHHI FHTFDELEPS IIKTLSLRYN HIYTIGPLQL    720
LLDQIPEEKK QTGITSLHGY SLVKEEPECF QWLQSKEPNS VVYVNFGSTT VMSLEDMTEF    780
GWGLANSNHY FLWIIRSNLV IGENAVLPPE LEEHIKKRGF IASWCSQEKV LKHPSVGGFL    840
THCGWGSTIE SLSAGVPMIC WPYSWDQLTN CRYICKEWEV GLEMGTKVKR DEVKRLVQEL    900
MGEGGHKMRN KAKDWKEKAR IAIAPNGSSS LNIDKMVKEI TVLARN                   946

SEQ ID NO: 147
Artificial Sequence
atggctgaac aacaaaagat caagaagtct ccacacgttt tgttgattcc atttccattg     60
caaggtcaca tcaacccatt cattcaattc ggtaagagat tgatttccaa gggtgttaag    120
actactttgg ttactaccat ccataccttg aactctactt tgaaccattc taacactacc    180
accacctcca ttgaaattca agctatttcc gatggttgtg atgaaggtgg ttttatgtct    240
gctggtgaat cttacttgga aacctttaag caagttggtt ctaagtcctt ggccgatttg    300
attaagaagt tgcaatctga aggtactacc attgatgcca ttatctacga ttctatgacc    360
gaatgggttt tggatgttgc tattgaattc ggtattgatg gtggttcatt cttcactcaa    420
gcttgtgttg ttaactcctt gtactaccat gttcacaagg gtttgatctc attgccattg    480
ggtgaaactg tttctgttcc aggtttccca gttttacaaa gatgggaaac tccattgatc    540
ttgcaaaacc acgaacaaat tcaatctcca tggtcccaaa tgttgtttgg tcaattcgcc    600
aacattgatc aagctagatg ggttttttacc aactccttct acaagttgga agaagagttt    660
atcgaatgga ccagaaagat ctggaacttg aaagttattg gtccaaccct gccatctatg    720
tacttggata gagattgga tgacgataag gacaacggtt tcaacttgta caaggctaac    780
catcatgaat gcatgaattg gttggacgac aagccaaaag aatccgttgt ttatgttgct    840
ttcggttctt tggtcaaaca tggtccagaa caagttgaag aaattaccag agccttgatc    900
gattccgatg ttaatttctt gtgggtcatc agcacaagaa aggaaggtaa attgccagaa    960
aacttgtccg aagttatcaa aactggtaag ggtttgattg tcgcttggtg taaacaattg   1020
gatgttttgg ctcatgaatc cgttggttgt tcgttactc attgtggttt caactccacc   1080
ttggaagcta tttctttggg tgttccagtt gttgctatgc cacaatttc tgatcaaact   1140
accaacgtca agttgttgga cgaaattttg ggtgttggtg ttagagttaa ggctgacgaa   1200
aatggtatcg ttagaagagg taacttggct tcttgcatca agatgatcat ggaagaagaa   1260
agaggtgtca tcattagaaa aacgctgtt aagtggaagg atttggctaa agttgctgtt   1320
catgaaggtg gtagttccga taatgatatc gttgaattgc tttccgaatt gatcaaggcc   1380
atggatgcta tggctaccac cgaaaaaaag ccacatgtta ttttcattcc attcccagct   1440
caatcccata ttaaggctat gttgaagttg gcccaattat tgcatcacaa gggtttacaa   1500
atcaccttcg ttaacaccga cttcatccac aatcaattct tggaatcttc tggtccacat   1560
tgcttggatg gtgctccagg ttttagattt gaaactattc cagatggtgt ttcccattct   1620
ccagaagctt ctattccaat tagagaatcc ttgttgagat ccatcgaaac taatttcttg   1680
gacagattca tcgacttggt tactaagttg ccagatccac caacctgtat tatttctgat   1740
ggtttcttgt ccgttttcac cattgatgct gctaagaaat tgggtatccc agttatgatg   1800
tactggactt tggctgcttg tggttttatg ggttctacc atatccattc cttgatcgaa   1860
aagggttttg ctccattgaa agatgcctct tacttgacta ccggttactt ggataccgtt   1920
attgattggg ttccaggtat ggaaggtatc agattgaagg attttccatt ggattggtcc   1980
actgatttga cgataaggt tttgatgttc actaccgaag ctccacaaag atctcataag   2040
gtttcccatc atatcttcca caccttcgat gaattggaac atccattat taagaccttg   2100
tccttgagat acaaccacat ctataccatt ggtccattgc aattattatt ggaccaaatc   2160
ccagaagaaa agaagcaaac tggtattact tccttgcacg gttactcatt ggtcaaagaa   2220
gaaccagaat gcttccaatg gttgcaatct aaagaaccta actccgttgt ctacgttaac   2280
tttggttcta ctaccgttat gtccttggaa gatatgactg aatttggttg gggtttggct   2340
aactctaacc attacttctt gtggatcatc agatccaact tggttattgg tgaaaacgct   2400
gttttgccac cagaattgga agaacatatc aagaagagag tttcattgc ttcttggtgt   2460
tcccaagaaa aggttttgaa acatccatct gtccggtggtt tcttgactca ttgtggttgg   2520
ggttctacca ttgaatcttt gtctgctggt gttccaatga tttgttggcc atattcttgg   2580
gatcaattga ccaactgcag atacatctgc aaagaatggg aagtcggttt ggaaatgggt   2640
acaaaagtca aagagatga agtcaagaga ttggtccaga ttgatggg tgaaggtggt   2700
cataagatga gaacaaagc caaggactgg aaagaaaagg ctagaattgc tattgctcca   2760
aacggttctt cctctttgaa cattgacaag atggtcaaag aaatcaccgt tttggccaga   2820
aactga                                                              2826

SEQ ID NO: 148
Artificial Sequence
MAEQQKIKKS PHVLLIPFPL QGHINPFIQF GKRLISKGVK TTLVTTIHTL NSTLNHSNTT     60
TTSIEIQAIS DGCDEGGFMS AGESYLETFK QVGSKSLADL IKKLQSEGTT IDAIIYDSMT    120
EWVLDVAIEF GIDGGSFFTQ ACVVNSLYYH VHKGLISLPL GETVSVPGFP VLQRWETPLI    180
LQNHEQIQSP WSQMLFGQFA NIDQARWVFT NSFYKLEEEV IEWTRKIWNL KVIGPTLPSM    240
YLDKRLDDDK DNGFNLYKAN HHECMNWLDD KPKESVVYVA FGSLVKHGPE QVEEITRALI    300
DSDVNFLWVI KHKEEGKLPE NLSEVIKTGK GLIVAWCKQL DVLAHESVGC FVTHCGFNST    360
LEAISLGVPV VAMPQFSDQT TNAKLLDEIL GVGVRVKADE NGIVRRGNLA SCIKMIMEEE    420
RGVIIRKNAV KWKDLAKVAV HEGGSSDNDI VEFVSELIKA MDAMATTEKK PHVIFIPFPA    480
QSHIKAMLKL AQLLHHKGLQ ITFVNTDFIH NQFLESSGPH CLDGAPGFRF ETIPDGVSHS    540
PEASIPIRES LLRSIETNFL DRFIDLVTKL PDPPTCIISD GFLSVFTIDA AKKLGIPVMM    600
YWTLAACGFM GFYHIHSLIE KGFAPLKDAS YLTNGYLDTV IDWVPGMEGI RLKDFPLDWS    660
```

TABLE 19-continued

Sequences disclosed herein.

```
TDLNDKVLMF TTEAPQRSHK VSHHIFHTFD ELEPSIIKTL SLRYNHIYTI GPLQLLLDQI    720
PEEKKQTGIT SLHGYSLVKE EPECFQWLQS KEPNSVVYVN FGSTTVMSLE DMTEFGWGLA    780
NSNHYFLWII RSNLVIGENA VLPPELEEHI KKRGFIASWC SQEKVLKHPS VGGFLTHCGW    840
GSTIESLSAG VPMICWPYSW DQLTNCRYIC KEWEVGLEMG TKVKRDEVKR LVQELMGEGG    900
HKMRNKAKDW KEKARIAIAP NGSSSLNIDK MVKEITVLAR N                       941

SEQ ID NO: 149
Artificial Sequence
atggatgcta tggctaccac cgaaaaaaag ccacatgtta ttttcattcc attcccagct     60
caatcccata ttaaggctat gttgaagttg gcccaattat tgcatcacaa gggtttacaa    120
atcaccttcg ttaacaccga cttcatccac aatcaattct tggaatcttc tggtccacat    180
tgcttggatg gtgctccagg ttttagattt gaaactattc cagatggtgt ttcccattct    240
ccagaagctt ctattccaat tagaaatcc ttgttgagat ccatcgaaac taatttcttg     300
gacagattca tcgacttggt tactaagttg ccagatccac caacctgtat tatttctgat    360
ggtttcttgt ccgttttcac cattgatgct gctaagaaat tgggtatccc agttatgatg    420
tactggactt tggctgcttg tggttttatg ggtttctacc atatccattc cttgatcgaa    480
aagggttttg ctccattgaa agatgcctct tacttgacta acggttactt ggataccgtt    540
attgattggg ttccaggtat ggaaggtatc agattgaagg attttccatt ggattggtcc    600
actgaattga acgataaggt tttgatgttc actaccgaag ctccacaaag atctcataag    660
gtttcccatc atatcttcca caccttcgat gaattgaac catccattat taagaccttg     720
tccttgagat acaaccacat ctataccatt ggtccattgc aattattatt ggaccaaatc    780
ccagaagaaa agaagcaaac tggtattact tccttgcacg ttactcatt ggtcaaagaa     840
gaaccagaat gcttccaatg gttgcaatct aaagaaccta actccgttgt ctacgttaac    900
tttggttcta ctaccgttat gtccttggaa gatatgactg aatttggttg gggtttggct    960
aactctaacc attacttctt gtggatcatc agatccaact tggttattgg tgaaaacgct   1020
gttttgccac cagaattgga agaacatatc aagaagagag tttcattgc ttcttggtgt    1080
tcccaagaaa aggttttgaa acatccatct gtcggtggtt tcttgactca ttgtggttgg   1140
ggttctacca ttgaatcttt gtctgctggt gttccaatga tttgttggcc atattcttgg   1200
gatcaattga ccaactgcag atacatctgc aaagaatggg aagtcggttt ggaaatgggt   1260
acaaaagtca aaagagatga agtcaagaga ttggtccaag aattgatggg tgaaggtggt   1320
cataagatga gaaacaaagc caaggactgg aagaaaagg ctagaattgc tattgctcca    1380
aacggttctt cctctttgaa cattgacaag atggtcaaag aaatcaccgt tttggccaga   1440
aac                                                                 1443

SEQ ID NO: 150
Artificial Sequence
RASSTKLVK                                                              9

SEQ ID NO: 151
Artificial Sequence
EGKSSGSGSE SKST                                                       14

SEQ ID NO: 152
Escherichia coli
MKAQYEDGKQ YTTLEKPVAG APQVLEFFSF FCPHCYQFEE VLHISDNVKK KLPEGVKMTK     60
YHVNFMGGDL GKDLTQAWAV AMALGVEDKV TVPLFEGVQK TQTIRSASDI RDVFINAGIK    120
GEEYDAAWNS FVVKSLVAQQ EKAAADVQLR GVPAMFVNGK YQLNPQGMDT SNMDVFVQQY    180
ADTVKYLSEK K                                                         191

SEQ ID NO: 153
Escherichia coli
MKTEEGKLVI WINGDKGYNG LAEVGKKFEK DTGIKVTVEH PDKLEEKFPQ VAATGDGPDI     60
IFWAHDRFGG YAQSGLLAEI TPDKAFQDKL YPFTWDAVRY NGKLIAYPIA VEALSLIYNK    120
DLLPNPPKTW EEIPALDKEL KAKGKSALMF NLQEPYFTWP LIAADGGYAF KYENGKYDIK    180
DVGVDNAGAK AGLTFLVDLI KNKHMNADTD YSIAEAAFNK GETAMTINGP WAWSNIDTSK    240
VNYGVTVLPT FKGQPSKPFV GVLSAGINAA SPNKELAKEF LENYLLTDEG LEAVNKDKPL    300
GAVALKSYEE ELAKDPRIAA TMENAQKGEI MPNIPQMSAF WYAVRTAVIN AASGRQTVDE    360
ALKDAQT                                                              367

SEQ ID NO: 154
Escherichia coli
MNKEILAVVE AVSNEKALPR EKIFEALESA LATATKKKYE QEIDVRVQID RKSGDFDTFR     60
RWLVVDEVTQ PTKEITLEAA RYEDESLNLG DYVEDQIESV TFDRITTQTA KQVIVQKVRE    120
AERAMVLRDQ REHEGEIITG VVKKVNRDNI SLDLGNNAEA VILREDMLPR ENFRPGDRVR    180
GVLYSVRPEA RGAQLFVTRS KPEMLIELFR IEVPEIGEEV IEIKAAARDP GSRAKIAVKT    240
NDKRIDPVGA CVGMRGARVQ AVSTELGGER IDIVLWDDNP AQFVINAMAP ADVASIVVDE    300
DKHTMDIAVE AGNLAQAIGR NGQNVRLASQ LSGWELNVMT VDDLQAKHQA EAHAAIDTFT    360
KYLDIDEDFA TVLVEEGFST LEELAYVPMK ELLEIEGLDE PTVEALRERA KNALATIAQA    420
QEESLGDNKP ADDLLNLEGV DRDLAFKLAA RGVCTLEDLA EQGIDDLADI EGLTDEKAGA    480
LIMAARNICW FGDEA                                                    495

SEQ ID NO: 155
Saccharomyces cerevisiae
MSDSEVNQEA KPEVKPEVKP ETHINLKVSD GSSEIFFKIK KTTPLRRLME AFAKRQGKEM     60
DSLTFLYDGI EIQADQTPED LDMEDNDIIE AHREQIGG                             98
```

TABLE 19-continued

Sequences disclosed herein.

SEQ ID NO: 156
*Escherichia coli*
```
atgaaagcgc aatatgaaga tggaaagcag tatacgacct tagaaaaacc agtcgctgga   60
gctccgcaag tcttggaatt ctttagtttt ttttgtccgc attgttacca gtttgaggaa  120
gtcttgcata tatccgacaa cgtcaaaaag aagttgccag aaggcgttaa aatgacgaaa  180
tatcacgtta actttatggg aggtgacttg ggaaaagatc ttactcaagc ctgggccgtt  240
gcaatggcat tgggagttga agataaagtt acagtgccct tgtttgaagg agttcaaaag  300
acccagacta taaggtcagc ctccgacatt agagacgtct ttatcaatgc tgggattaag  360
ggcgaagagt atgatgccgc gtggaactcc tttgttgtca agagtttagt cgcacaacaa  420
gaaaaggctg ctgcagacgt tcagttaagg ggtgtgccag ccatgttcgt taatggtaag  480
tatcagttaa atccacaggg gatggataca tcaaacatgg atgtgttcgt gcaacagtac  540
gcagacactg ttaaatattt gtcagagaag aaa                               573
```

SEQ ID NO: 157
*Escherichia coli*
```
atgaaaacag aagaagggaa attggttata tggataaacg gtgataaggg ctataacgga   60
ttagccgagg taggtaagaa gtttgaaaaa gatactggta taaaagttac tgttgaacat  120
ccggacaaac tggaagaaaa atttcctcaa gttgctgcaa ctggcgatgg tccagatata  180
atcttctggg cacatgacag attcggcggt tacgcacagt cggcgattgct ggctgagatc  240
accccctgaca aggcgttcca agataagcta tacccttta catgggacgc agtgagatac  300
aatgcgaaat tgcttgcctta cccaattgca gttgaggcac tgtctctgat ttacaataag  360
gacttgctac caaaccctcc aaaaacctgg gaagaaatcc cagccctgga caagaacta   420
aaagctaaag gaaaatccgc ccttgatgtt aacttgcaag agccttattt cacatggccg  480
ctaattgctg cagatggcgg ttatgctttt aaatatgaaa acggtaagta tgacatcaaa  540
gatgttggag tcgacaatgc aggtgctaag gccggcttaa ctttcttagt ggacttaatc  600
aagaataagc atatgaatgc agacactgat tacagcatag cggaggctgc tttcaacaaa  660
ggtgaaacag ctatgacaat aaatggcct tgggcctggt ctaatatcga cacgtctaaa  720
gttaattatg gggtaacagt acttccaacg tttaaaggcc agccatcaaa gccctttgta  780
ggtgtcctga gtgccggtat taacgcagcc agcccgaaca aagagttagc gaaagaattc  840
ttagaaaatt atttactgac cgatgagggt cttgaagcag tgaacaagga taaacctttg  900
ggtgcagtcg ctttgaagag ttacgaagaa gaactggcta aggaccccag aattgcagcc  960
actatggaaa atgcccaaaa gggagaaatt atgccaaata tacctcaaat gtcagccttc 1020
tggtatgcgg ttaggactgc cgttataaac gctgctagtg aaggcagac ggtggatgaa  1080
gcacttaaag atgcgcagac a                                           1101
```

SEQ ID NO: 158
*Escherichia coli*
```
atgaataagg agattctagc agtcgttgaa gcagtaagta acgaaaaagc attgcctagg   60
gagaaaatct cgaagccct agaaagcgct ttggccacag ccacgaaaaa gaagtacgag  120
caagaaaattg acgttagagt tcagatcgac aggaaatcag gtgatttcga tacatttagg  180
agatggttag tagtagatga ggttacacag cctactaagg agattacatt agaggcggcc  240
agatacgaag acgaatcttt gaacttaggg gactatgttg aggatcaaat tgaatcagtt  300
acttttgata gaattacaac tcaaacagcc aaacaagtca tagttcaaaa agtgagggaa  360
gccgaaagag caatggtggt cgaccaattt cgtgagcacg aaggagagat cataaccaggt  420
gtcgttaaaa aggttaatag agataatatt tcttttggat ctttgggaataa tgccgaagct  480
gttatcctga gggaagatat gttgccgagg gaaaatttca gacctggaga tcgtgtcaga  540
ggtgtttttgt attctgtacg tccagaggca agaggagctc aattattttgt tactcgttct  600
aaaccggaga tgcttattga actatttagg attgaggtgc ctgaaattgg aggaagaagtt  660
attgagatca aagccgctgc acgtgatcca ggatcaagag cgaagattgc tgttaaaaca  720
aatgataaac gtatcgatcc cgtgggtgcg tgtgttggta tgaggggtgc tagagtccag  780
gctgtaagca ccgaactggg aggcgagagg attgacattg tcttgtggga cgataatcct  840
gcccagtttg taataaacgc aatggctcct gctgatgtgg cctctatagt cgtggatgag  900
gacaaacata ccatggatat agcagtagaa gctggtaatt tagcccaagc aattggaaga  960
aacggtcaaa acgtccgttt agcttcccag ttgtctggtt gggaactgaa cgtgatgacg 1020
gttgatgatt tacaagctaa gcaccaagca gaggctcatg cagcgattga taccttcact 1080
aaatatctag atatagacga ggattttgca actgtgcttg ttgaagaagg cttttctacg 1140
ttagaagaac tagcttacgt cccaatgaag gaattattag aaatcgaggg tttggatgaa 1200
cctacagtgg aggctttgag agaaagggcc aagaatgccc tagcaactat agctcaagca 1260
caagaggaat cactgggaga taataagcct gcagacgatt tgctgaacct agaaggtgta 1320
gatagggact tggcttttaa gctagcagcc agaggcgtgt gtacactaga ggatttggct 1380
gaacaaggaa tagatgacct agctgacatt gaagggttga cagatgaaaa agctgggcc  1440
ttaataatgg ccgctaggaa tatttgctgg ttcggggatg aggca                 1485
```

SEQ ID NO: 159
*Saccharomyces cerevisiae*
```
atgagtgact ctgaagtgaa tcaagaggct aaaccagaag taaagcccga agtaaagcca   60
gagacccaca tcaacttgaa ggtttcagac gggtcttcag agatattctt taaaatcaaa  120
aagacaacgc ccttgagaag gctaatggaa gcgtttgcca agagacaagg aaaagaaatg  180
gatagtttaa ctttcttgta cgatgggatt gagattcaag cagatcaaac tccggaagat  240
ttggacatgg aagataatga tatcattgaa gctcatagag aacaaatcgg aggt         294
```

SEQ ID NO: 160
Artificial Sequence
```
atggctgaac aacaaaagat caagaagtct ccacacgttt tgttgattcc atttccattg   60
caaggtcaca tcaacccatt cattcaattc ggtaagagat tgatttccaa gggtgttaag  120
actactttgg ttactaccat ccataccttg aactctacct tgaaccattc taacactacc  180
accaccctcca ttgaaattca agctatttcc gatggttgtg atgaaggtgg ttttatgtct  240
tggggtgaat cttacttgga aacctttaag caagttggtt ctaagtcctt ggccgatttg  300
```

TABLE 19-continued

Sequences disclosed herein.

```
attaagaagt tgcaatctga aggtactacc attgatgcca ttatctacga ttctatgacc    360
gaatgggttt tggatgttgc tattgaattc ggtattgatg gtggttcatt cttcactcaa    420
gcttgtgttg ttaactcctt gtactaccat gttcacaagg gtttgatctc attgccattg    480
ggtgaaactg tttctgttcc aggtttccca gttttacaaa gatgggaaac tccattgatc    540
ttgcaaaacc acgaacaaat tcaatctcca tggtcccaaa tgttgtttgg tcaattcgcc    600
aacattgatc aagctagatg ggttttacc aactccttct acaagttgga agaagaagtt    660
atcgaatgga ccagaaagat ctggaacttg aaagttattg gtccaacctt gccatctatg    720
tacttggata agagattgga tgacgataag gacaacggtt tcaacttgta caaggctaac    780
catcatgaat gcatgaattg gttggacgac aagccaaaag aatccgttgt ttatgttgct    840
ttcggttctt tggtcaaaca tggtccagaa caagttgaag aaattaccag agccttgatc    900
gattccgatg ttaatttctt gtgggtcatc aagcacaaag aagaaggtaa attgccagaa    960
aacttgtccg aagttatcaa aactggtaag ggtttgattg tcgcttggtg taaacaattg   1020
gatgttttgg ctcatgaatc cgttggttgt tcgttactc attgtggttt caactccacc   1080
ttggaagcta tttctttggg tgttccagtt gttgctatgc cacaatttc tgatcaaact   1140
accaacgcta agttgttgga cgaaattttg ggtgttggtg ttagagttaa ggctgacgaa   1200
aatggtatcg ttagaagagg taacttggct tcttgcatca agatgatcat ggaagaagaa   1260
agaggtgtca tcattagaaa gaacgctgtt aagtggaagg atttggctaa agttgctgtt   1320
catgaaggtg gtagttccga taatgatatc gttgaattcg tttccgaatt gatcaaggcc   1380
taa                                                                 1383

SEQ ID NO: 161
Artificial Sequence
MAEQQKIKKS PHVLLIPFPL QGHINPFIQF GKRLISKGVK TTLVTTIHTL NSTLNHSNTT     60
TTSIEIQAIS DGCDEGGFMS WGESYLETFK QVGSKSLADL IKKLQSEGTT IDAIIYDSMT    120
EWVLDVAIEF GIDEGGSFFTQ ACVVNSLYYH VHKGLISLPL GETVSVPGFP VLQRWETPLI   180
LQNHEQIQSP WSQMLFGQFA NIDQARWVFT NSFYKLEEEV IEWTRKIWNL KVIGPTLPSM    240
YLDKRLDDDK DNGFNLYKAN HHECMNWLDD KPKESVVYVA FGSLVKHGPE QVEEITRALI    300
DSDVNFLWVI KHKEEGKLPE NLSEVIKTGK GLIVAWCKQL DVLAHESVGC FVTHCGFNST    360
LEAISLGVPV VAMPQFSDQT TNAKLLDEIL GVGVRVKADE NGIVRRGNLA SCIKMIMEEE    420
RGVIIRKNAV KWKDLAKVAV HEGGSSDNDI VEFVSELIKA                         460

SEQ ID NO: 162
Artificial Sequence
atggctgaac aacaaaagat caagaagtct ccacacgttt tgttgattcc atttccattg     60
caaggtcaca tcaacccatt cattcaattc ggtaagagat tgatttccaa gggtgttaag    120
actactttgg ttactaccat ccataccttg aactctacct tgaaccattc taacactacc    180
accacctcca ttgaaattca agctatttcc gatggttgtg atgaaggtgg ttttatgtct    240
gctggtgaat cttacttgga aacctttaag caagttggtt ctaagtcctt ggccgatttg    300
attaagaagt tgcaatctga aggtactacc attgatgcca ttatctacga ttctatgacc    360
gaatgggttt tggatgttgc tattgaattc ggtattgatg gtggttcatt cttcactcaa    420
gcttgtgttg ttaactcctt gtactaccat gttcacaagg gtttgatctc attgccattg    480
ggtgaaactg tttctgttcc aggtttccca gttttacaaa gatgggaaac tccattgatc    540
ttgcaaaaca ctgaacaaat tcaatctcca tggtcccaaa tgttgtttgg tcaattcgcc    600
aacattgatc aagctagatg ggttttacc aactccttct acaagttgga agaagaagtt    660
atcgaatgga ccagaaagat ctggaacttg aaagttattg gtccaacctt gccatctatg    720
tacttggata agagattgga tgacgataag gacaacggtt tcaacttgta caaggctaac    780
catcatgaat gcatgaattg gttggacgac aagccaaaag aatccgttgt ttatgttgct    840
ttcggttctt tggtcaaaca tggtccagaa caagttgaag aaattaccag agccttgatc    900
gattccgatg ttaatttctt gtgggtcatc aagcacaaag aagaaggtaa attgccagaa    960
aacttgtccg aagttatcaa aactggtaag ggtttgattg tcgcttggtg taaacaattg   1020
gatgttttgg ctcatgaatc cgttggttgt tcgttactc attgtggttt caactccacc   1080
ttggaagcta tttctttggg tgttccagtt gttgctatgc cacaatttc tgatcaaact   1140
accaacgcta agttgttgga cgaaattttg ggtgttggtg ttagagttaa ggctgacgaa   1200
aatggtatcg ttagaagagg taacttggct tcttgcatca agatgatcat ggaagaagaa   1260
agaggtgtca tcattagaaa gaacgctgtt aagtggaagg atttggctaa agttgctgtt   1320
catgaaggtg gtagttccga taatgatatc gttgaattcg tttccgaatt gatcaaggcc   1380
taa                                                                 1383

SEQ ID NO: 163
Artificial Sequence
MAEQQKIKKS PHVLLIPFPL QGHINPFIQF GKRLISKGVK TTLVTTIHTL NSTLNHSNTT     60
TTSIEIQAIS DGCDEGGFMS AGESYLETFK QVGSKSLADL IKKLQSEGTT IDAIIYDSMT    120
EWVLDVAIEF GIDGGSFFTQ ACVVNSLYYH VHKGLISLPL GETVSVPGFP VLQRWETPLI    180
LQNTEQIQSP WSQMLFGQFA NIDQARWVFT NSFYKLEEEV IEWTRKIWNL KVIGPTLPSM    240
YLDKRLDDDK DNGFNLYKAN HHECMNWLDD KPKESVVYVA FGSLVKHGPE QVEEITRALI    300
DSDVNFLWVI KHKEEGKLPE NLSEVIKTGK GLIVAWCKQL DVLAHESVGC FVTHCGFNST    360
LEAISLGVPV VAMPQFSDQT TNAKLLDEIL GVGVRVKADE NGIVRRGNLA SCIKMIMEEE    420
RGVIIRKNAV KWKDLAKVAV HEGGSSDNDI VEFVSELIKA                         460

SEQ ID NO: 164
Artificial Sequence
atggctgaac aacaaaagat caagaagtct ccacacgttt tgttgattcc atttccattg     60
caaggtcaca tcaacccatt cattcaattc ggtaagagat tgatttccaa gggtgttaag    120
actactttgg ttactaccat ccataccttg aactctacct tgaaccattc taacactacc    180
accacctcca ttgaaattca agctatttcc gatggttgtg atgaaggtgg ttttatgtct    240
gctggtgaat cttacttgga aacctttaag caagttggtt ctaagtcctt ggccgatttg    300
attaagaagt tgcaatctga aggtactacc attgatgcca ttatctacga ttctatgacc    360
gaatgggttt tggatgttgc tattgaattc ggtattgatg gtggttcatt cttcactcaa    420
```

TABLE 19-continued

Sequences disclosed herein.

```
gcttgtgttg ttaactcctt gtactaccat gttcacaagg gtttgatctc attgccattg      480
ggtgaaactg tttctgttcc aggtttccca gttttacaaa gatgggaaac tccattgatc      540
ttgcaaaacc acgaacaaat tcaatctcca tggtcccaaa tgttgtttgg tcaattcgcc      600
aacattgatc aagctagatg gttttttacc aactccttct acaagttgga agaagaagtt      660
atcgaatgga ccagaaagat ctggaacttg aaagttattg gtccaacctt gccatctatg      720
tacttggata agagattgga tgacgataag gacaacggtt tcaacttgta caaggctaac      780
catcatgaat gcatgaattg gttggacgac aagccaaaag aatccgttgt ttatgttgct      840
ttcggttctt tggtcaatca tggtccagaa caagttgaag aaattaccag agccttgatc      900
gattccgatg ttaatttctt gtgggtcatc aagcacaaag aagaaggtaa attgccagaa      960
aacttgtccg aagttatcaa aactggtaag ggtttgattg tcgcttggtg taaacaattg     1020
gatgttttgg ctcatgaatc cgttggttgt ttcgttactc attgtggttt caactccacc     1080
ttggaagcta tttctttggg tgttccagtt gttgctatgc cacaattttc tgatcaaact     1140
accaacgcta agttgttgga cgaaattttg ggtgttggtg ttagagttaa ggctgacgaa     1200
aatggtatcg ttagaagagg taacttggct tcttgcatca agatgatcat ggaagaagaa     1260
agaggtgtca tcattagaaa gaacgctgtt aagtggaagg atttggctaa agttgctgtt     1320
catgaaggtg gtagttccga taatgatatc gttgaattcg tttccgaatt gatcaaggcc     1380
taa                                                                   1383

SEQ ID NO: 165
Artificial Sequence
MAEQQKIKKS PHVLLIPFPL QGHINPFIQF GKRLISKGVK TTLVTTIHTL NSTLNHSNTT       60
TTSIEIQAIS DGCDEGGFMS AGESYLETFK QVGSKSLADL IKKLQSEGTT IDAIIYDSMT      120
EWVLDVAIEF GIDGGSFFTQ ACVVNSLYYH VHKGLISLPL GETVSVPGFP VLQRWETPLI      180
LQNHEQIQSP WSQMLFGQFA NIDQARWVFT NSFYKLEEEV IEWTRKIWNL KVIGPTLPSM      240
YLDKRLDDDK DNGFNLYKAN HHECMNWLDD KPKESVVYVA FGSLVNHGPE QVEEITRALI      300
DSDVNFLWVI KHKEEGKLPE NLSEVIKTGK GLIVAWCKQL DVLAHESVGC FVTHCGFNST      360
LEAISLGVPV VAMPQFSDQT TNAKLLDEIL GVGVRVKADE NGIVRRGNLA SCIKMIMEEE      420
RGVIIRKNAV KWKDLAKVAV HEGGSSDNDI VEFVSELIKA                            460

SEQ ID NO: 166
Artificial Sequence
atggctgaac aacaaaagat caagaagtct ccacacgttt tgttgattcc atttccattg       60
caaggtcaca tcaacccatt cattcaattc ggtaagagat tgatttccaa gggtgttaag      120
actactttgg ttactaccat ccatacccttg aactctacct tgaaccattc taacactacc      180
accacctcca ttgaaattca agctatttcc gatggttgtg atgaaggtgg ttttgaatct      240
gctggtgaat cttacttgga aacctttaag caagttggtt ctaagtcctt ggccgatttg      300
attaagaagt tgcaatctga aggtactacc attgatgcca ttatctacga ttctatgacc      360
gaatgggttt tggatgttgc tattgaattc ggtattgatg gtggtcatt cttcactcaa      420
gcttgtgttg ttaactcctt gtactaccat gttcacaagg gtttgatctc attgccattg      480
ggtgaaactg tttctgttcc aggtttccca gttttacaaa gatgggaaac tccattgatc      540
ttgcaaaacc acgaacaaat tcaatctcca tggtcccaaa tgttgtttgg tcaattcgcc      600
aacattgatc aagctagatg gttttttacc aactccttct acaagttgga agaagaagtt      660
atcgaatgga ccagaaagat ctggaacttg aaagttattg gtccaacctt gccatctatg      720
tacttggata agagattgga tgacgataag gacaacggtt tcaacttgta caaggctaac      780
catcatgaat gcatgaattg gttggacgac aagccaaaag aatccgttgt ttatgttgct      840
ttcggttctt tggtcaaaca tggtccagaa caagttgaag aaattaccag agccttgatc      900
gattccgatg ttaatttctt gtgggtcatc aagcacaaag aagaaggtaa attgccagaa      960
aacttgtccg aagttatcaa aactggtaag ggtttgattg tcgcttggtg taaacaattg     1020
gatgttttgg ctcatgaatc cgttggttgt ttcgttactc attgtggttt caactccacc     1080
ttggaagcta tttctttggg tgttccagtt gttgctatgc cacaattttc tgatcaaact     1140
accaacgcta agttgttgga cgaaattttg ggtgttggtg ttagagttaa ggctgacgaa     1200
aatggtatcg ttagaagagg taacttggct tcttgcatca agatgatcat ggaagaagaa     1260
agaggtgtca tcattagaaa gaacgctgtt aagtggaagg atttggctaa agttgctgtt     1320
catgaaggtg gtagttccga taatgatatc gttgaattcg tttccgaatt gatcaaggcc     1380
taa                                                                   1383

SEQ ID NO: 167
Artificial Sequence
MAEQQKIKKS PHVLLIPFPL QGHINPFIQF GKRLISKGVK TTLVTTIHTL NSTLNHSNTT       60
TTSIEIQAIS DGCDEGGFES AGESYLETFK QVGSKSLADL IKKLQSEGTT IDAIIYDSMT      120
EWVLDVAIEF GIDGGSFFTQ ACVVNSLYYH VHKGLISLPL GETVSVPGFP VLQRWETPLI      180
LQNHEQIQSP WSQMLFGQFA NIDQARWVFT NSFYKLEEEV IEWTRKIWNL KVIGPTLPSM      240
YLDKRLDDDK DNGFNLYKAN HHECMNWLDD KPKESVVYVA FGSLVKHGPE QVEEITRALI      300
DSDVNFLWVI KHKEEGKLPE NLSEVIKTGK GLIVAWCKQL DVLAHESVGC FVTHCGFNST      360
LEAISLGVPV VAMPQFSDQT TNAKLLDEIL GVGVRVKADE NGIVRRGNLA SCIKMIMEEE      420
RGVIIRKNAV KWKDLAKVAV HEGGSSDNDI VEFVSELIKA                            460

SEQ ID NO: 168
Artificial Sequence
atggctgaac aacaaaagat caagaagtct ccacacgttt tgttgattcc atttccattg       60
caaggtcaca tcaacccatt cattcaattc ggtaagagat tgatttccaa gggtgttaag      120
actactttgg ttactaccat ccatacccttg aactctacct tgaaccattc taacactacc      180
accacctcca ttgaaattca agctatttcc gatggttgtg atgaaggtgg ttttatgtct      240
gctggtgaat cttacttgga aacctttaag caagttggtt ctaagtcctt ggccgatttg      300
attaagaagt tgcaatctga aggtactacc attgatgcca ttatctacga ttctatgacc      360
gaatgggttt tggatgttgc tattgaattc ggtattgatg gtggtcatt cttcactcaa      420
gcttgtgttg ttaactcctt gtactaccat gttcacaagg gtttgatctc attgccattg      480
ggtgaaactg tttctgttcc aggtttccca gttttacaaa gatgggaaac tccattgatc      540
```

TABLE 19-continued

Sequences disclosed herein.

```
ttgcaaaacc acgaacaaat tcaatctcca tggtcccaaa tgttgtttgg tcaattcgcc    600
aacattgatc aagctagatg ggttttacc aactccttct acaagttgga agaagaagtt    660
atcgaatgga ccagaaagat ctggaacttg aaagttattg gtccaacctt gccatctatg    720
tacttggata agagattgga tgacgataag gacaacggtt tcaacttgta caaggctaac    780
catcatgaat gcatgaattg gttggacgac aagccaaaag aatccgttgt ttatgttgct    840
ttcggttctt tggtcactca tggtccagaa caagttgaag aaattaccag agccttgatc    900
gattccgatg ttaatttctt gtgggtcatc aagcacaaag aagaaggtaa attgccagaa    960
aacttgtccg aagttatcaa aactggtaag ggtttgattg tcgcttggtg taaacaattg   1020
gatgttttgg ctcatgaatc cgttggttgt ttcgttactc attgtggttt caactccacc   1080
ttggaagcta tttctttggg tgttccagtt gttgctatgc cacaattttc tgatcaaact   1140
accaacgcta agttgttgga cgaaattttg ggtgttggtg ttagagttaa ggctgacgaa   1200
aatggtatcg ttagaagagg taacttggct tcttgcatca agatgatcat ggaagaagaa   1260
agaggtgtca tcattagaaa aacgctgtt aagtggaagg atttggctaa agttgctgtt   1320
catgaaggtg gtagttccga taatgatatc gttgaattcg tttccgaatt gatcaaggcc   1380
taa                                                                 1383

SEQ ID NO: 169
Artificial Sequence
MAEQQKIKKS PHVLLIPFPL QGHINPFIQF GKRLISKGVK TTLVTTIHTL NSTLNHSNTT     60
TTSIEIQAIS DGCDEGGFMS AGESYLETFK QVGSKSLADL IKKLQSEGTT IDAIIYDSMT    120
EWVLDVAIEF GIDGGSFFTQ ACVVNSLYYH VHKGLISLPL GETVSVPGFP VLQRWETPLI    180
LQNHEQIQSP WSQMLFGQFA NIDQARWVFT NSFYKLEEEV IEWTRKIWNL KVIGPTLPSM    240
YLDKRLDDDK DNGFNLYKAN HHECMNWLDD KPKESVVYVA FGSLVTHGPE QVEEITRALI    300
DSDVNFLWVI KHKEEGKLPE NLSEVIKTGK GLIVAWCKQL DVLAHESVGC FVTHCGFNST    360
LEAISLGVPV VAMPQFSDQT TNAKLLDEIL GVGVRVKADE NGIVRRGNLA SCIKMIMEEE    420
RGVIIRKNAV KWKDLAKVAV HEGGSSDNDI VEFVSELIKA                          460

SEQ ID NO: 170
Artificial Sequence
gcacacacca tagcttcaaa atgtttctac tccttttta ctcttccaga ttttctcgga     60
ctccgcgcat cgccgtacca cttcaaaaca cccaagcaca gcatactaaa tttcccctct    120
ttcttcctct agggtgtcgt taattcccg tactaaaggt ttggaaaaga aaaaagagac    180
cgcctcgttt cttttttcttc gtcgaaaaag gcaataaaaa ttttttatcac gtttctttt    240
cttgaaaatt ttttttttg attttttttct ctttcgatga cctcccattg atatttaagt    300
taataaaacgg tcttcaattt ctcaagtttc agtttcattt ttcttgttct attacaactt    360
ttttttacttc ttgctcatta gaaagaaagc atagcaatct aatctaagtt ttaattacaa    420

SEQ ID NO: 171
Artificial Sequence
gtagatacgt tgttgacact tctaaataag cgaatttctt atgatttatg attttttatta    60
ttaaataagt tataaaaaaa ataagtgtat acaaatttta aagtgactct taggttttaa    120
aacgaaaatt cttattcttg agtaactctt tcctgtaggt caggttgctt tctcaggtat    180
agcatgaggt cgctc                                                     195

SEQ ID NO: 172
Artificial Sequence
gaaggtaaat cctctggctc aggtagcgag tctaaaagta cc                        42

SEQ ID NO: 173
Artificial Sequence
atgaaagcgc aatatgaaga tggaaagcag tatacgacct tagaaaaacc agtcgctgga     60
gctccgcaag tcttggaatt cttttagtttt ttttgtccgc attgttacca gtttgaggaa    120
gtcttgcata tatccgacaa cgtcaaaaag aagttgccag aaggcgttaa aatgacgaaa    180
tatcacgtta actttatggg aggtgacttg ggaaaagatc ttactcaagc ctgggccgtt    240
gcaatggcat tgggagttga agataaagtt acagtgccct tgtttgaagg agttcaaaag    300
acccagacta taaggtcagc ctccgacatt agagacgtct ttatcaatgc tgggattaag    360
ggcgaagagt atgatgccgc gtggaactcc tttgttgtca agagtttagt cgcacaacaa    420
gaaaaggctg ctgcagacgt tcagttaagg ggtgtgccag ccatgttcgt taatggtaag    480
tatcagttaa atccacaggg gatggataca tcaaacatgg atgtgttcgt gcaacagtac    540
gcagacactg ttaaatattt gtcagagaag aaagaaggta atcctctgg ctcaggtagc    600
gagtctaaaa gtaccatggc tgaacaacaa aagatcaaga agtctccaca cgttttgttg    660
attccatttc cattgcaagg tcacatcaac ccattcattc aattcggtaa gagattgatt    720
tccaagggtg ttaagactac tttggttact accatccata ccttgaactc taccttgaac    780
cattctaaca ctaccaccac ctccattgaa attcaagcta tttccgatgg ttgtgatgaa    840
ggtggtttta tgtctgctgg taatcttac ttggaaacct ttaagcaagt tggttctaag    900
tccttggccg atttgattaa gaagttgcaa tctgaagcta ctaccattga tgccattatc    960
tacgattcta tgaccgaatg ggttttggat gttgctattg aattcggtat tgatggtggt   1020
tcattcttca ctcaagcttg tgttgttaac tccttgtact accatgttca caaggggtttg   1080
atctcattgc cattgggtga aactgttttct gttccaggtt tcccagtttt acaaagatgg   1140
gaaactccat tgatcttgca aaaccacgaa caaattcaat ctccatggtc ccaaatgttg   1200
tttggtcaat tcgccaacat tgatcaagct agatgggttt taccaactcc ttctacaag    1260
ttggaagaag aagttatcga atggaccaga aagatctgga acttgaaagt tattggtcca   1320
accttgccat ctatgtactt ggataagaga ttggatgacg ataaggacaa cggtttcaac   1380
ttgtacaagg ctaaccatca tgaatgcatg aattggttgg acgacaagcc aaaagaatcc   1440
gttgtttatg ttgctttcgg ttctttggtc aacatggtc cagaacaagt tgaagaaatt   1500
accagagcct tgatcgattc cgatgttaat ttcttgtggg tcatcaagca caagaagaa   1560
ggtaaattgc cagaaaactt gtccgaagtt atcaaaactg gtaagggttt gattgtcgct   1620
tggtgtaaac aattggatgt tttggctcat gaatccgttg gttgtttcgt tactcattgt   1680
```

TABLE 19-continued

Sequences disclosed herein.

```
ggtttcaact ccaccttgga agctatttct ttgggtgttc cagttgttgc tatgccacaa  1740
ttttctgatc aaactaccaa cgctaagttg ttggacgaaa ttttgggtgt tggtgttaga  1800
gttaaggctg acgaaaatgg tatcgttaga agaggtaact tggcttcttg catcaagatg  1860
atcatggaag aagaaagagg tgtcatcatt agaagaacg ctgttaagtg aaggatttg   1920
gctaaagttg ctgttcatga aggtggtagt tccgataatg atatcgttga attcgtttcc  1980
gaattgatca aggcctaa                                               1998

SEQ ID NO: 174
Artificial Sequence
MKAQYEDGKQ YTTLEKPVAG APQVLEFFSF FCPHCYQFEE VLHISDNVKK KLPEGVKMTK    60
YHVNFMGGDL GKDLTQAWAV AMALGVEDKV TVPLFEGVQK TQTIRSASDI RDVFINAGIK   120
GEEYDAAWNS FVVKSLVAQQ EKAAADVQLR GVPAMFVNGK YQLNPQGMDT SNMDVFVQQY   180
ADTVKYLSEK KEGKSSGSGS ESKSTMAEQQ KIKKSPHVLL IPFPLQGHIN PFIQFGKRLI   240
SKGVKTTLVT TIHTLNSTLN HSNTTTTSIE IQAISDGCDE GGFMSAGESY LETFKQVGSK   300
SLADLIKKLQ SEGTTIDAII YDSMTEWVLD VAIEFGIDGG SFFTQACVVN SLYYHVKGL    360
ISLPLGETVS VPGFPVLQRW ETPLILQNHE QIQSPWSQML FGQFANIDQA RWVFTNSFYK   420
LEEEVIEWTR KIWNLKVIGP TLPSMYLDKR LDDDKDNGFN LYKANHHECM NWLDDKPKES   480
VVYVAFGSLV KHGPEQVEEI TRALIDSDVN FLWVIKHKEE GKLPENLSEV IKTGKGLIVA   540
WCKQLDVLAH ESVGCFVTHC GFNSTLEAIS LGVPVVAMPQ FSDQTTNAKL LDEILGVGVR   600
VKADENGIVR RGNLASCIKM IMEEERGVII RKNAVKWKDL AKVAVHEGGS SDNDIVEFVS   660
ELIKA                                                              665

SEQ ID NO: 175
Artificial Sequence
atgaaaacag aagaagggaa attggttata tggataaacg gtgataaggg ctataacgga    60
ttagccgagg taggtaagaa gtttgaaaaa gatactggta taaagttac tgttgaacat   120
ccggacaaac tggaagaaaa atttcctcaa gttgctgaca ctggcgatgg tccagatata   180
atcttctggg cacatgacag attcggcggt tacgcacagt ccggattgct ggctgagatc   240
accctgaca aggcgttcca agataagcta taccctttta catgggacac agtgagatac   300
aatgaaaat tgattgctta cccaattgca gttgaggcac tgtctctgat ttacaataag   360
gacttgctac caaaccctcc aaaaacctgg aagaaatcc cagccctgga caagaacta   420
aaagctaaag gaaaatccgc cttgatgttt aacttgcaag agccttattt cacatggccg   480
ctaattgctg cagatggcgg ttatgctttt aaatatgaaa acggtaagta tgacatcaaa   540
gatgttggag tcgacaatgc aggtgctaag gccggcttaa cttttcttagt ggacttaatc   600
aagaataagc atatgaatgc agacactgat tacagcatag cggaggctgc tttcaacaaa   660
ggtgaaacag ctatgacaat aaatgccct tgggcctggt ctaatatcga cacgtctaaa   720
gttaattatg gggtaacagt acttccaacg tttaaaggcc agccatcaaa gcccttgta    780
ggtgtcctga gtgccggtat taacgcagcc agccccgaaca aagagttagc gaaagaattc   840
ttagaaaatt atttactgac cgatgagggt cttgaagcag tgaacaagga taaaccttg   900
ggtgcagtcg cttttgaagag ttacgaagaa gaactggcta cagcccag aattgcagcc   960
actatggaaa atgccaaaa gggagaaatt atgccaaata tacctcaaat gtcagccttc  1020
tggtatgcgg ttaggactgc cgttataaac gctgctagtg gaaggcagac ggtggatgaa  1080
gcacttaaag atgcgcagac agaaggtaaa tcctctggct caggtagcga gtctaaaagt  1140
accatggctg aacaacaaaa gatcaagaag tctccacacg ttttgttgat tccatttcca  1200
ttgcaaggtc acatcaaccc attcattcaa ttcggtaaga gattgattc caagggtgtt  1260
aagactactt tggttactac catccatacc ttgaactcta ccttgaacca ttctaacact  1320
accaccacct ccattgaaat tcaagctatt tccgatggtt gtgatgaagg tggttttatg  1380
tctgctggtg aatcttactt ggaaaccttt aagcaagttg gttctaagtc cttggccgat  1440
ttgattaaga gttgcaatc tgaaggtact accattgatg ccattatcta cgattctatg  1500
accgaatggg ttttggatgt tgctattgaa tccggtattg atggtggttc attcttcact  1560
caagcttgtg ttgttaactc cttgtactac catgttcaca agggtttgat ctcattgcca  1620
ttgggtgaaa ctgtttctgt tccagttttc ccagttttac aaagatggga aactccattg  1680
atcttgcaaa accacgaaca aattcaatct ccatggtccc aaatgttgtt tggtcaattc  1740
gccaacattg atcaagctag atgggttttt accaactcct tctacaagtt ggaagaagaa  1800
gttatcgaat ggaccagaaa gatctggaac ttgaaagtta ttggtccaac cttgccatct  1860
atgtacttgg ataagagatt ggatgacgat aaggacaacg gtttcaactt gtacaaggct  1920
aaccatcatg aatgcatgaa ttggttggac gacaagccaa agaatccgt tgtttatgtt  1980
gctttcggtt ctttggtcaa acatggtcca gaacaagttg aagaaattac cagagccttg  2040
atcgattccg atgttaattt cttgtgggtc atcaagcaca aagaagaagg taaattgcca  2100
gaaaacttgt ccgaagttat caaaactggt aagggttga ttgtcgcttg gtgtaaacaa  2160
ttggatgttt tggctcatga atccgttggt tgtttcgtta ctcattgtgg tttcaactcc  2220
accttggaag ctatttcttt gggtgttcca gttgttgcta tgccacaatt ttctgatcaa  2280
actaccaacg ctaagttgtt ggacgaaatt ttgggtgttg gtgttagagt taaggctgac  2340
gaaaatggta tcgttagaag aggtaacttg gcttcttgca tcaagatgat catggaagaa  2400
gaaagaggtg tcatcattag aaagaacgct gttaagtgaa ggatttggc taaagttgct  2460
gttcatgaag gtggtagttc cgataatgat atcgttgaat tcgtttccga attgatcaag  2520
gcctaa                                                            2526

SEQ ID NO: 176
Artificial Sequence
MKTEEGKLVI WINGDKGYNG LAEVGKKFEK DTGIKVTVEH PDKLEEKFPQ VAATGDGPDI    60
IFWAHDRFGG YAQSGLLAEI TPDKAFQDKL YPFTWDAVRY NGKLIAYPIA VEALSLIYNK   120
DLLPNPPKTW EEIPALDKEL KAKGKSALMF NLQEPYFTWP LIAADGGYAF KYENGKYDIK   180
DVGVDNAGAK AGLTFLVDLI KNKHMNADTD YSIAEAAFNK GETAMTINGP WAWSNIDTSK   240
VNYGVTVLPT FKGQPSKPFV GVLSAGINAA SPNKELAKEF LENYLLTDEG LEAVNKDKPL   300
GAVALKSYEE ELAKDPRIAA TMENAQKGEI MPNIPQMSAF WYAVRTAVIN AASGRQTVDE   360
ALKDAQTEGK SSGSGSESKS TMAEQQKIKK SPHVLLIPFP LQGHINPFIQ FGKRLISKGV   420
KTTLVTTIHT LNSTLNHSNT TTTSIEIQAI SDGCDEGGFM SAGESYLETF KQVGSKSLAD   480
```

TABLE 19-continued

Sequences disclosed herein.

```
LIKKLQSEGT TIDAIIYDSM TEWVLDVAIE FGIDGGSFFT QACVVNSLYY HVHKGLISLP      540
LGETVSVPGF PVLQRWETPL ILQNHEQIQS PWSQMLFGQF ANIDQARWVF TNSFYKLEEE      600
VIEWTRKIWN LKVIGPTLPS MYLDKRLDDD KDNGFNLYKA NHHECMNWLD DKPKESVVYV      660
AFGSLVKHGP EQVEEITRAL IDSDVNFLWV IKHKEEGKLP ENLSEVIKTG KGLIVAWCKQ      720
LDVLAHESVG CFVTHCGFNS TLEAISLGVP VVAMPQFSDQ TTNAKLLDEI LGVGVRVKAD      780
ENGIVRRGNL ASCIKMIMEE ERGVIIRKNA VKWKDLAKVA VHEGGSSDND IVEFVSELIK      840
A                                                                     841

SEQ ID NO: 177
Artificial Sequence
atgaataagg agattctagc agtcgttgaa gcagtaagta acgaaaaagc attgcctagg       60
gagaaaatct tcgaagccct agaaagcgct ttggccacag ccacgaaaaa gaagtacgag      120
caagaaattg acgttagagt tcagatcgac aggaaatcag gtgatttcga tacatttagg      180
agatggttag tagtagatga ggttacacag cctactaagg agattacatt agaggcggcc      240
agatacgaag acgaatcttt gaacttaggg gactatgttg aggatcaaat tgaatcagtt      300
acttttgata gaattacaac tcaaacagcc aaacaagtca tagttcaaaa agtgagggaa      360
gccgaaagag caatggtggt cgaccaattt cgtgagcacg aaggagagat cataacaggt      420
gtcgttaaaa aggttaatag agataatatt tcttttggatc ttgggaataa tgccgaagct      480
gttatcctga gggaagatat gttgccgagg gaaaattca gacctggtga tcgtgtcaga      540
ggtgttttgt attctgtacg tccagaggca gaggagctc aattatttgt tactcgttct      600
aaaccggaga tgcttattga actatttagg attgaggtgc ctgaaattgg agaagaagtt      660
attgagatca aagccgctgc acgtgatcca ggatcaagag cgaagattgc tgttaaaaca      720
aatgataaac gtatcgatcc cgtgggtgcg tgtgttggta tgaggggtgc tagagtccag      780
gctgtaagca ccgaactggg aggcgagagg attgacattg tcttgtggga cgataatcct      840
gcccagtttg taataaacgc aatggctcct gctgatgtgg cctctatagt cgtggatgag      900
gacaaacata ccatggatat agcagtagaa gctggtaatt tagcccaagc aattggaaga      960
aacggtcaaa acgtccgttt agcttcccag ttgtctggtt gggaactgaa cgtgatgacg     1020
gttgatgatt tacaagctaa gcaccaagca gaggctcatg cagcgattga tacctcact     1080
aaatatctag atatagacga ggattttgca actgtgcttg ttgaagaagg cttttctacg     1140
ttagaagaac tagcttacgt cccaatgaag gaattattag aaatcgaggg tttgatgaa     1200
cctacagtgg aggctttgag agaaagggcc aagaatgccc tagcaactat agctcaagca     1260
caagagaat cactgggaga taataagcct gcagacgatt tgctgaacct agaaggtgta     1320
gataggact tggcttttaa gctagcagcc agaggcgtgt gtacactaga ggatttggct     1380
gaacaaggaa tagatgacct agctgacatt gaagggttga cagatgaaaa agctggggcc     1440
ttaataatgg ccgctaggaa tatttgctgg ttcggggatg aggcagaagg taaatcctct     1500
ggctcagtgg gcgagtctaa aaagtaccatg gctgaacaac aaaagatcaa gaagtctcca     1560
cacgttttgt tgattccatt tccattgcaa ggtcacatca cccattcat tcaattcggt     1620
aagagattga tttccaaggg tgttaagact actttggtta ctaccatcca taccttgaac     1680
tctaccttga accattctaa cactaccacc acctccattg aaattcaagc tatttccgat     1740
ggttctgatg aagtggttt tatgtctgct ggtgaatctt acttggaaac ctttaagcaa     1800
gttggttcta agtccttggc cgatttgatt aagaagttgc aatctgaagg tactaccatt     1860
gatgccatta tctacgattc tatgaccgaa tgggttttgg atgttgctat tgaattcggt     1920
attgatggtg gttcattctt cactcaagct tgtgttgtta actccttgta ctaccatgtt     1980
cacaagggtt tgatctcatt gccattgggt gaaactgttt ctgttccagg tttcccagtt     2040
ttacaaagat gggaaactcc attgatcttg caaaaccacg aacaaattca atctccatgg     2100
tcccaaatgt tgtttggtca attcgccaac attgatcaag ctagatgggt ttttaccaac     2160
tccttctaca agtggaaga agaagttatc gaatggacca gaaagatctg gaacttgaaa     2220
gttattggtc caaccttgcc atctatgtac ttggataaga gattggatga cgataaggac     2280
aacggtttca acttgtacaa ggctaaccat catgaatgca tgaattggtt ggacgacaag     2340
ccaaaagaat ccgttgttta tgttgctttc ggttctttgg tcaaacatgg tccagaacaa     2400
gttgaagaaa ttaccagagc cttgatcgat tccgatgtta atttcttgtg ggtcatcaag     2460
cacaagaag aagtaaatt gccagaaaac ttgtccgaag ttatcaaaac tggtaagggt     2520
ttgattgtcg cttggtgtaa acaattggat gttttggctc atgaatccgt tggttgtttc     2580
gttactcatt gtggtttcaa ctccacccttg gaagctattt ctttgggtgt tccagttgtt     2640
gctatgccac aattttctga tcaaactacc aacgctaagt tgttggacga attttggg     2700
gttggtgtta gagttaaggc tgacgaaaat ggtatcgtta gaagaggtaa cttggcttct     2760
tgcatcaaga tgatcatgga agaagaaaga ggtgtcatca ttagaaagaa cgctgttaag     2820
tggaaggatt tggctaaagt tgctgttcat gaaggtggta gttccgataa tgatatcgtt     2880
gaattcgttt ccgaattgat caaggcctaa                                    2910

SEQ ID NO: 178
Artificial Sequence
MNKEILAVVE AVSNEKALPR EKIFEALESA LATATKKKYE QEIDVRVQID RKSGDFDTFR       60
RWLVVDEVTQ PTKEITLEAA RYEDESLNLG DYVEDQIESV TFDRITTQTA KQVIVQKVRE      120
AERAMVVDQF REHEGEIITG VVKKVNRDNI SLDLGNNAEA VILREDMLPR ENFRPGDRVR      180
GVLYSVRPEA RGAQLFVTRS KPEMLIELFR IEVPEIGEEV IEIKAAARDP GSRAKIAVKT      240
NDKRIDPVGA CVGMRGARVQ AVSTELGGER IDIVLWDDNP AQFVINAMAP ADVASIVVDE      300
DKHTMDIAVE AGNLAQAIGR NGQNVRLASQ LSGWELNVMT VDDLQAKHQA EAHAAIDTFT      360
KYLDIDEDFA TVLVEEGFST LEELAYVPMK ELLEIEGLDE PTVEALRERA KNALATIAQA      420
QEESLGDNKP ADDLLNLEGV DRDLAFKLAA RGVCTLEDLA EQGIDDLADI EGLTDEKAGA      480
LIMAARNICW FGDEAEGKSS GSGSESKSTM AEQQKIKKSP HVLLIPFFPLQ GHINPFIQFG    540
KRLISKGVKT TLVTTIHTLN STLNHSNTTT TSIEIQAISD GCDEGGFMSA GESYLETFKQ      600
VGSKSLADLI KKLQSEGTTI DAIIYDSMTE WVLDVAIEFG IDGGSFFTQA CVVNSLYYHV      660
HKGLISLPLG ETVSVPGFPV LQRWETPLIL QNHEQIQSPW SQMLFGQFAN IDQARWVFTN      720
SFYKLEEEVI EWTRKIWNLK VIGPTLPSMY LDKRLDDDKD NGFNLYKANH HECMNWLDDK      780
PKESVVYVAF GSLVKHGPEQ VEEITRALID SDVNFLWVIK HKEEGKLPEN LSEVIKTGKG      840
LIVAWCKQLD VLAHESVGCF VTHCGFNSTL EAISLGVPVV AMPQFSDQTT NAKLLDEILG      900
```

TABLE 19-continued

Sequences disclosed herein.

```
VGVRVKADEN GIVRRGNLAS CIKMIMEEER GVIIRKNAVK WKDLAKVAVH EGGSSDNDIV    960
EFVSELIKA                                                           969

SEQ ID NO: 179
Artificial Sequence
atgagtgact ctgaagtgaa tcaagaggct aaaccagaag taaagcccga agtaaagcca    60
gagacccaca tcaacttgaa ggtttcagac gggtcttcag agatattctt taaaatcaaa   120
aagacaacgc ccttgagaag gctaatgaaa gcgtttgcca agagacaagg aaaagaaatg   180
gatagtttaa ctttcttgta cgatgggatt gagattcaag cagatcaaac tccggaagat   240
ttggacatga agataatga tatcattgaa gctcatagag aacaaatcgg aggtgaaggt   300
aaatcctctg gctcaggtag cgagtctaaa agtaccatgg ctgaacaaca aaagatcaag   360
aagtctccac acgttttgtt gattccattt ccattgcaag tcacatcaa cccattcatt    420
caattcggta agagattgat ttccaagggt gttaagacta ctttggttac taccatccat   480
accttgaact ctaccttgaa ccattctaac actaccacca cctccattga aattcaagct   540
atttccgatg gttgtgatga aggtggtttt atgtctgctg gtaatcttca cttggaaacc   600
tttaagcaag ttggttctaa gtccttggcc gatttgatta agaagttgca atctgaaggt   660
actaccattg atgccattat ctacgattct atgaccgaat gggttttgga tgttgctatt   720
gaattcggta ttgatggtgg ttcattcttc actcaagctt gtgttgttaa ctccttgtac   780
taccatgtc acaagggttt gatctcattg ccattgggtg aaactgtttc tgttccaggt    840
ttcccagttt tacaaagatg ggaaactcca ttgatcttgc aaaaccacga acaaattcaa   900
tctccatggt cccaaatgtt gtttggtcaa ttcgccaaca ttgatcaagc tagatgggtt   960
tttaccaact ccttctacaa gttggaagaa gaagttatcg aatggaccag aaagatctgg  1020
aacttgaaag ttattggtcc aaccttgcca tctatgtacc tggataagag attggataac  1080
gataaggaca acgtttcaa cttgtacaag gctaaccatc atgaatgcat gaattggttg   1140
gacgacaagc caaagaatc cgttgtttat gttgctttcg ttctttggt caaacatggt    1200
ccagaacaag ttgaagaaat taccagagcc ttgatcgatt ccgatgttaa tttcttgtgg  1260
gtcatcaagc acaaagaaga aggtaaattg ccagaaaact tgtccgaagt tatcaaaact  1320
ggtaagggtt tgattgtcgc ttggtgtaaa caattggatg ttttggctca tgaatccgtt  1380
ggttgtttcg ttactcattg tggtttcaac tccaccttgg aagctatttc tttgggtgtt  1440
ccagttgttg ctatgccaca attttctgat caaactacca acgctaagtt gttggacgaa  1500
attttgggtg ttggtgttag agttaaggct gacgaaaatg gtatcgttag aagaggtaac  1560
ttggcttctt gcatcaagat gatcatgaaa gaagaaagag gtgtcatcat tagaaagaac  1620
gctgttaagt ggaaggattt ggctaaagtt gctgttcatg aaggtggtag ttccgataat  1680
gatatcgttg aattcgtttc cgaattgatc aaggcctaa                          1719

SEQ ID NO: 180
Artificial Sequence
MSDSEVNQEA KPEVKPEVKP ETHINLKVSD GSSEIFFKIK KTTPLRRLME AFAKRQGKEM    60
DSLTFLYDGI EIQADQTPED LDMEDNDIIE AHREQIGGEG KSSGSGSESK STMAEQQKIK   120
KSPHVLLIPF PLQGHINPFI QFGKRLISKG VKTTLVTTIH TLNSTLNHSN TTTTSIEIQA   180
ISDGCDEGGF MSAGESYLET FKQVGSKSLA DLIKKLQSEG TTIDAIIYDS MTEWVLDVAI   240
EFGIDGGSFF TQACVVNSLY YHVHKGLISL PLGETVSVPG FPVLQRWETP LILQNHEQIQ   300
SPWSQMLFGQ FANIDQARWV FTNSFYKLEE EVIEWTRKIW NLKVIGPTLP SMYLDKRLDD   360
DKDNGFNLYK ANHHECMNWL DDKPKESVVY VAFGSLVKHG PEQVEEITRA LIDSDVNFLW   420
VIKHKEEGKL PENLSEVIKT GKGLIVAWCK QLDVLAHESV GCFVTHCGFN STLEAISLGV   480
PVVAMPQFSD QTTNAKLLDE ILGVGVRVKA DENGIVRRGN LASCIKMIME EERGVIIRKN   540
AVKWKDLAKV AVHEGGSSDN DIVEFVSELI KA                                 572

SEQ ID NO: 181
Saccharomyces cerevisiae
atgtctagtc aaacagaaag aacttttatt gcggtaaaac cagatggtgt ccagaggggc    60
ttagtatctc aaattctatc tcgttttgaa aaaaaaggtt acaaactagt tgctattaaa   120
ttagttaaag cggatgataa attactagag caacattacg cagagcatgt tggtaaacca   180
ttttcccaa agatggtatc ctttatgaag tctggtccca ttttggccac ggtctgggag    240
ggaaaagatg tggttagaca aggaagaact attcttggtg ctactaatcc tttgggcagt   300
gcaccaggta ccattagagg tgatttcggt attgacctag cagaaacgt ctgtcacggc    360
agtgattctg ttgatagcgc tgaacgtgaa tcaatttgt ggtttaagaa ggaagagtta   420
gttgattggg aatctaatca agctaagtgg atttatgaat ga                      462

SEQ ID NO: 182
Saccharomyces cerevisiae
MSSQTERTFI AVKPDGVQRG LVSQILSRFE KKGYKLVAIK LVKADDKLLE QHYAEHVGKP    60
FFPKMVSFMK SGPILATVWE GKDVVRQGRT ILGATNPLGS APGTIRGDFG IDLGRNVCHG   120
SDSVDSAERE INLWFKKEEL VDWESNQAKW IYE                                153

SEQ ID NO: 183
Artificial Sequence
atccgctcta accgaaaagg aaggagttag acaacctgaa gtctaggtcc ctatttattt    60
tttttaatag ttatgttagt attaagaacg ttatttatat ttcaaatttt tcttttttt   120
ctgtacaaac gcgtgtacgc atgtaacatt atactgaaaa ccttgcttga aaggttttg    180
ggacgctcga ag                                                       192

SEQ ID NO: 184
Saccharomyces cerevisiae
atgtcacttc taatagattc tgtaccaaca gttgcttata aggaccaaaa accgggtact    60
tcaggtttac gtaagaagac caaggttttc atggatgagc tcattatac tgagaacttc   120
attcaagcaa caatgcaatc tatccctaat ggctcagagg gaaccacttt agttgttgga   180
ggagatggtc gttctacaa cgatgttatc atgaacaaga ttgccgcagt aggtgctgca   240
```

TABLE 19-continued

Sequences disclosed herein.

```
aacggtgtca gaaagttagt cattggtcaa ggcggtttac tttcaacacc agctgcttct    300
catataatta gaacatacga ggaaaagtgt accggtggtg gtatcatatt aactgcctca    360
cacaacccag gcggtccaga gaatgattta ggtatcaagt ataatttacc taatggtggg    420
ccagctccag agagtgtcac taacgctatc tgggaagcgt ctaaaaaatt aactcactat    480
aaaattataa agaacttccc caagttgaat ttgaacaagc ttggtaaaaa ccaaaaatat    540
ggcccattgt tagtggacat aattgatcct gccaaagcat acgttcaatt tctgaaggaa    600
atttttgatt ttgacttaat taaaagcttc ttagcgaaac agcgcaaaga caaagggtgg    660
aagttgttgt ttgactcctt aaatggtatt acaggaccat atggtaaggc tatatttgtt    720
gatgaatttg gttaccggc agaggaagtt cttcaaaatt ggcacccttt acctgatttc    780
ggcggtttac atcccgatcc gaatctaacc tatgcacgaa ctcttgttga cagggttgac    840
cgcgaaaaaa ttgcctttgg agcagcctcc gatggtgatg gtgataggaa tatgatttac    900
ggttatggcc ctgctttcgt ttcgccaggt gattctgttg ccattattgc cgaatatgca    960
cccgaaattc catacttcgc caaacaaggt atttatggct tggcacgttc atttcctaca   1020
tcctcagcca ttgatcgtgt tgcagcaaaa aagggattaa gatgttacga agttccaacc   1080
ggctggaaat tcttctgtgc cttatttgat gctaaaaagc tatcaatctg tggtgaagaa   1140
tccttcggta caggttccaa tcatatcaga gaaaaggacg gtctatgggc cattattgct   1200
tggttaaata tcttggctat ctaccatagg cgtaaccctg aaaaggaagc ttcgatcaaa   1260
actattcagg acgaatttttg gaacgagtat ggccgtactt tcttcacaag atacgattac   1320
gaacatatcg aatgcgagca ggccgaaaaa gttgtagctc ttttgagtga atttgtatca   1380
aggccaaacg tttgtggctc ccacttccca gctgatgagt ctttaaccgt tatcgattgt   1440
ggtgattttt cgtatagaga tctagatggc tccatctctg aaaatcaagg ccttttcgta   1500
aagttttcga atgggactaa atttgttttg aggttatccg gcacaggcag ttctggtgca   1560
acaataagat tatacgtaga aaagtatact gataaaaagg agaactatgg ccaaacagct   1620
gacgtcttct tgaaacccgt catcaactcc attgtaaaat tcttaagatt taagaaatt    1680
ttaggaacag acgaaccaac agtccgcaca tag                                1713

SEQ ID NO: 185
Saccharomyces cerevisiae
MSLLIDSVPT VAYKDQKPGT SGLRKKTKVF MDEPHYTENF IQATMQSIPN GSEGTTLVVG     60
GDGRFYNDVI MNKIAAVGAA NGVRKLVIGQ GGLLSTPAAS HIIRTYEEKC TGGGIILTAS    120
HNPGGPENDL GIKYNLPNGG PAPESVTNAI WEASKKLTHY KIIKNFPKLN LNKLGKNQKY    180
GPLLVDIIDP AKAYVQFLKE IFDFDLIKSF LAKQRKDKGW KLLFDSLNGI TGPYGKAIFV    240
DEFGLPAEEV LQNWHPLPDF GGLHPDPNLT YARTLVDRVD REKIAFGAAS DGDGDRNMIY    300
GYGPAFVSPG DSVAIIAEYA PEIPYFAKQG IYGLARSFPT SSAIDRVAAK KGLRCYEVPT    360
GWKFFCALFD AKKLSICGEE SFGTGSNHIR EKDGLWAIIA WLNILAIYHR RNPEKEASIK    420
TIQDEFWNEY GRTFFTRYDY EHIECEQAEK VVALLSEFVS RPNVCGSHFP ADESLTVIDC    480
GDFSYRDLDG SISENQGLFV KFSNGTKFVL RLSGTGSSGA TIRLYVEKYT DKKENYGQTA    540
DVFLKPVINS IVKFLRFKEI LGTDEPTVRT                                     570

SEQ ID NO: 186
Saccharomyces cerevisiae
atgtcatttc aaattgaaac ggttcccacc aaaccatatg aagaccaaaa gcctggtacc     60
tctggtttgc gtaagaagac aaaggtgttt aaagacgaac ctaactacac agaaaatttc    120
attcaatcga tcatgaaagc tattccagag ggttctaaag gtgccactct tgttgtcggt    180
ggtgatgggc gttactacaa tgatgtcatt cttcataaga ttgccgctat cggtgctgcc    240
aacggtatta aaaagttagt tattggccag catggtcttc tgtctacgcc agccgctct     300
cacatcatga gaacctacga ggaaaatgt actggtggta tatcttaac cgcctcacat     360
aatccaggtg gtccagaaaa tgacatgggt attaagtata acttatccaa tggggtcct    420
gctcctgaat ccgtcacaaa tgctatttgg gagatttcca aaaagcttac cagctataag    480
attatcaaag acttcccaga actagacttg gtacgatag caagaacaa gaaatacggt    540
ccattactcg ttgacattat cgatattaca aaagattatg tcaacttctt gaaggaaatc    600
ttcgatttcg acttaatcaa gaaattcatc gataatcaac gttctactaa gaattggaag    660
ttactgtttg acagtatgaa cggtgtaact ggaccatacg gtaaggctat tttcgttgat    720
gaatttggtt taccggcgga tgaggtttta caaaactggc atccttctcc ggattttggt    780
ggtatgcatc cagatccaaa cttaacttat gccagttcgt tagtgaaaag agtagatcgt    840
gaaaagattg agtttggtgc tgcatccgat ggtgatggtg ataganatat gatttacggt    900
tacggcccat ctttcgtttc tccaggtgac tccgtcgcaa ttattgccga atatgcagct    960
gaaatcccat atttcgccaa gcaaggtata tatggtctgg cccgttcatt ccctacctca   1020
ggagccatag accgtgttgc caaggcccat ggtctaaact gttatgaggt cccaactggc   1080
tggaaatttt tctgtgcttt gttcgacgct aaaaaattat ctatttgtgg tgaagaatcg   1140
tttggtactg gttccaacca cgtaagggaa aaggacggtg tttgggccat tatgcgctgg   1200
ttgaacatct tggccattta caacaagcat catccggaga acgaagcttc tattaagacg   1260
atacagaatg aattctgggc aaagtacggc cgtactttct tcactcgtta tgattttgaa   1320
aaagttgaaa cagaaaaagc taacaagatt gtcgatcaat gagagcata tgttaccaaa   1380
tcgggtgttg ttaattccgc ctttcccagcc gatgagtctc ttaaggtcac cgattgtggt   1440
gatttttcat acacagattt ggacggttct gtttctgacc atcaaggttt atatgtcaag   1500
ctttccaatg gtgcaagatt cgttctaaga ttgtcaggta caggttcttc aggtgctacc   1560
attagattgt acattgaaaa atactgcgat gataaatcac aataccaaaa gacagctgaa   1620
gaatacttga agcaattat taactcggtc atcaagttct tgaactttaa acaagtttta   1680
ggaactgaag aaccaacggt tcgtacttaa                                    1710

SEQ ID NO: 187
Saccharomyces cerevisiae
MSFQIETVPT KPYEDQKPGT SGLRKKTKVF KDEPNYTENF IQSIMEAIPE GSKGATLVVG     60
GDGRYYNDVI LHKIAAIGAA NGIKKLVIGQ HGLLSTPAAS HIMRTYEEKC TGGGIILTASH   120
NPGGPENDMG IKYNLSNGGP APESVTNAIW EISKKLTSYK IIKDFPELDL GTIGKNKKYG    180
PLLVDIIDIT KDYVNFLKEI FDFDLIKKFI DNQRSTKNWK LLFDSMNGVT GPYGKAIFVD    240
EFGLPADEVL QNWHPSPDFG GMHPDPNLTY ASSLVKRVDR EKIEFGAASD GDGDRNMIYG    300
```

TABLE 19-continued

Sequences disclosed herein.

```
YGPSFVSPGD SVAIIAEYAA EIPYFAKQGI YGLARSFPTS GAIDRVAKAH GLNCYEVPTG  360
WKFFCALFDA KKLSICGEES FGTGSNHVRE KDGVWAIMAW LNILAIYNKH HPENEASIKT  420
IQNEFWAKYG RTFFTRYDFE KVETEKANKI VDQLRAYVTK SGVVNSAFPA DESLKVTDCG  480
DFSYTDLDGS VSDHQGLYVK LSNGARFVLR LSGTGSSGAT IRLYIEKYCD DKSQYQKTAE  540
EYLKPIINSV IKFLNFKQVL GTEEPTVRT                                   569

SEQ ID NO: 188
Artificial Sequence
ggaagtacct tcaaagaatg gggtcttatc ttgttttgca agtaccactg agcaggataa   60
taatagaaat gataatatac tatagtagag ataacgtcga tgacttccca tactgtaatt  120
gcttttagtt gtgtattttt agtgtgcaag tttctgtaaa tcgattaatt ttttttttctt  180
tcctcttttt attaacctta attttatttt tagattcctg acttcaactc aagacgcaca  240
gatattataa catctgcata ataggcattt gcaagaatta ctcgtgagta aggaaagagt  300
gaggaactat cgcatacctg catttaaaga tgccgatttg ggcgcgaatc ctttattttg  360
gcttcaccct catactatta tcagggccag aaaaaggaag tgtttccctc cttcttgaat  420
tgatgttacc ctcataaagc acgtggcctc ttatcgagaa agaaattacc gtcgctcgtg  480
atttgtttgc aaaaagaaca aaactgaaaa aacccagaca cgctcgactt cctgtcttcc  540
tattgattgc agcttccaat ttcgtcacac aacaaggtcc tagcgacggc tcacaggttt  600
tgtaacaagc aatcgaaggt tctggaatgg cgggaaaggg tttagtacca catgctatga  660
tgcccactgt gatctccaga gcaaagttcg ttcgatcgta ctgttactct ctctctttca  720
aacagaattg tccgaatcgt gtgacaacaa cagcctgttc tcacacactc ttttcttcta  780
accaaggggg tggtttagtt tagtagaacc tcgtgaaact tacatttaca tatatataaa  840
cttgcataaa ttggtcaatg caagaaatac atatttggtc ttttctaatt cgtagttttt  900
caagttctta gatgctttct ttttctcttt tttacagatc atcaaggaag taattatcta  960
cttttttacaa caaatataaa acaa                                       984

SEQ ID NO: 189
Saccharomyces cerevisiae
atgtccacta agaagcacac caaaacacat tccacttatg cattcgagag caacacaaac   60
agcgttgctg cctcacaaat gagaaacgcc ttaaacaagt tggcggactc tagtaaactt  120
gacgatgctg ctcgcgctaa gtttgagaac gaactggatt cgttttcac gcttttcagg   180
agatatttgg tagagaagtc ttctagaacc accttggata gggacaagat caagtctccc  240
aacccggatg aagtggttaa gtatgaaatt atttctcagc agcccgagaa tgtctcaaac  300
ctttccaaat tggctgtttt gaagttgaac ggtgggctgg gtacctccat gggctgcgtt  360
ggccctaaat ctgttattga agtgagagag ggaaacacct tttggatttt gtctgttcgt  420
caaattgaat acttgaacag acagtacgat agcgacgtgc cattgttatt gatgaattct  480
ttcaacactg acaaggatac ggaacacttg attaagaagt attccgctaa cagaatcaga  540
atcagatctt tcaatcaatc caggttccca agagtctaca aggattcttt attgcctgtc  600
cccaccgaat acgattctcc actggatgct tggtatccac caggtcacgg tgatttgttt  660
gaatctttac acgtaattgg tgaactggat gcctaattg cccaaggaag agaaatatta  720
tttgttttcta acggtgacaa cttgggtgct accgtcgact taaaaatttt aaaccacatg  780
atcgagactg tgccgaata tataatgaa ttgactgata agaccagagc cgatgttaaa  840
ggtggtactt tgatttctta cgatggtcaa gtccgtttat tggaagtcgc ccaagttcca  900
aaagaacaca ttgacgaatt caaaaatatc agaaagttca ccaacttcaa cacgaataac  960
ttatggatca atctgaaagc agtaaagagg ttgatcgaat cgagcaattt ggagatggaa 1020
atcattccaa accaaaaaac tataacaaga gacggtcatg aaattaatgt cttacaatta 1080
gaaaccgctt gtggtgctgc tatcaggcat tttgatggtg ctcacggtgt tgtcgttcca 1140
agatcaagat tcttgcctgt caagacctgt tccgatttgt tgctggttaa atcagatcta 1200
ttccgtctgg aacacggttc tttgaagtta gacccatccc gttttggtcc aaacccatta 1260
atcaagttgg gctcgcattt caaaaaggtt tctggtttta acgcaagaat ccctcacatc 1320
ccaaaaatcg tcgagctaga tcatttgacc atcactggta acgtcttttt aggtaaagat 1380
gtcactttga ggggtactgt catcatcgtt gctccgacg tcataaaat cgatattcca 1440
aacggctcca tattggaaaa tgttgtcgtt actggtaatt gcaaatctt ggaacattga 1500

SEQ ID NO: 190
Saccharomyces cerevisiae
MSTKKHTKTH STYAFESNTN SVAASQMRNA LNKLADSSKL DDAARAKFEN ELDSFFTLFR   60
RYLVEKSSRT TLEWDKIKSP NPDEVVKYEI ISQQPENVSN LSKLAVLKLN GGLGTSMGCV  120
GPKSVIEVRE GNTFLDLSVR QIEYLNRQYD SDVPLLLMNS FNTDKDTEHL IKKYSANRIR  180
IRSFNQSRFP RVYKDSLLPV PTEYDSPLDA WYPPGHGDLF ESLHVSGELD ALIAQGREIL  240
FVSNGDNLGA TVDLKILNHM IETGAEYIME LTDKTRADVK GGTLISYDGQ VRLLEVAQVP  300
KEHIDEFKNI RKFTNFNTNN LWINLKAVKR LIESSNLEME IIPNQKTITR DGHEINVLQL  360
ETACGAAIRH FDGAHGVVVP RSRFLPVKTC SDLLLVKSDL FRLEHGSLKL DPSRFGPNPL  420
IKLGSHFKKV SGFNARIPHI PKIVELDHLT ITGNVFLGKD VTLRGTVIIV CSDGHKIDIP  480
NGSILENVVV TGNLQILEH                                               499
```

SEQ ID NO:191
Artificial Sequence
KLVK 4

SEQ ID NO:192
Artificial Sequence
GGGGS 5

SEQ ID NO:193
Artificial Sequence
GGGGSGGGGS 10

SEQUENCE LISTING (193 sequences)

SEQ ID NO: 1 - DNA, 1383 bp, Artificial Sequence
  Codon-optimized UGT74G1
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 2 - DNA, 1383 bp, Artificial Sequence
  UGT74G1 Var_1
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcgaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 3 - DNA, 1383 bp, Stevia rebaudiana
atggcagagcaacaaaagatcaaaaagtcacctcacgtcttacttattccatttcctctgcaaggacatatcaacccattcatacaatttgggaaaagattgattagtaagggtgtaaagacaacactggtaaccactatccacactttgaattctactctgaaccactcaaatactactactacaagtatagaaattcaagctatatcagacggatgcgatgagggtggctttatgtctgccggtgaatcttacttggaaacattcaagcaagtgggatccaagtctctggccgatctaatcaaaaagttacagagtgaaggcaccacaattgacgccataatctacgattctatgacagagtgggttttagacgttgctatcgaatttggtattgatggaggttcctttttcacacaagcatgtgttgtgaattctctatactaccatgtgcataaagggttaatctctttaccattgggtgaaactgtttcagttccaggttttccagtgttacaacgttgggaaaccccattgatcttacaaaatcatgaacaaatacaatcaccttggtcccagatgttgtttggtcaattcgctaacatcgatcaagcaagatgggtctttactaattcattctataagttagaggaagaggtaattgaatggactaggaagatctggaatttgaaagtcattggtccaacattgccatcaatgtatttggacaaaagacttgatgatgataaagataatggtttcaatttgtacaaggctaatcatcacgaatgtatgaattggctggatgacaaaccaaaggaatcagttgtatatgttgctttcggctctcttgttaaacatggtccagaacaagttgaggagattacaagagcacttatagactctgacgtaaactttttgtgggtcattaagcacaaagaggaggggaaactgccagaaaacctttctgaagtgataaagaccggaaaaggtctaatcgttgcttggtgtaaacaattggatgttttagctcatgaatctgtaggctgttttgtaacacattgcggattcaactctacactagaagccatttccttaggcgtacctgtcgttgcaatgcctcagttctccgatcagacaaccaacgctaaacttttggacgaaatactaggggtgggtgtcagagttaaagcagacgagaatggtatcgtcagaagagggaacctagcttcatgtatcaaaatgatcatggaagaggaaagaggagttatcataaggaaaaacgcagttaagtggaaggatcttgcaaaggttgccgtccatgaaggcggctcttcagataatgatattgttgaatttgtgtccgaactaatcaaagcctaa

SEQ ID NO: 4 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 5 - DNA, 1586 bp, Stevia rebaudiana
atggatgcaatggctacaactgagaagaaaccacacgtcatcttcataccatttccagcacaaagccacattaaagccatgctcaaactagcacaacttctccaccacaaaggactccagataaccttcgtcaacaccgacttcatccacaaccagtttcttgaatcatcgggcccacattgtctagacggtgcaccgggtttccggttcgaaaccattccggatggtgtttctcacagtccggaagcgagcatcccaatcagagaatcactcttgagatccattgaaaccaacttcttggatcgtttcattgatcttgtaaccaaacttccggatcctccgacttgtattatctcagatgggttcttgtcggttttcacaattgacgctgcaaaaaagcttggaattccggtcatgatgtattggacacttgctgcctgtgggttcatgggtttttaccatattcattctctcattgagaaaggatttgcaccacttaaagatgcaagttacttgacaaatgggtatttggacaccgtcattgattgggttccgggaatggaaggcatccgtctcaaggatttcccgctggactggagcactgacctcaatgacaaagttttgatgttcactacggaagctcctcaaaggtcacacaaggtttcacatcatattttccacacgttcgatgagttggagcctagtattataaaaactttgtcattgaggtataatcacatttacaccatcggcccactgcaattacttcttgatcaaatacccgaagagaaaaagcaaactggaattacgagtctccatggatacagtttagtaaaagaagaaccagagtgtttccagtggcttcagtctaaagaaccaaattccgtcgtttatgtaaattttggaagtactacagtaatgtctttagaagacatgacggaatttggttggggacttgctaatagcaaccattatttcctttggatcatccgatcaaacttggtgataggggaaaatgcagttttgccccctgaacttgaggaacatataaagaaaagaggctttattgctagctggtgttcacaagaaaaggtcttgaagcacccttcggttggagggttcttgactcattgtgggtggggatcgaccatcgagagcttgtctgctggggtgccaatgatatgctggccttattcgtgggaccagctgaccaactgtaggtatatatgcaaagaatgggaggttgggctcgagatgggaaccaaagtgaaacgagatgaagtcaagaggcttgtacaagagttgatgggagaaggaggtcacaaaatgaggaacaaggctaaagattggaaagaaaaggctcgcattgcaatagctcctaacggttcatcttctttgaacatagacaaaatggtcaaggaaatcaccgtgctagcaagaaactagttacaaagttgtttcacattgtgctttctatttaagatgtaactttgttctaatttaatattgtctagatgtattgaaccataagtttagttggtctcaggaattgatttttaatgaaataatggtcattaggggtgagt

SEQ ID NO: 6 - DNA, 1446 bp, Artificial Sequence
  Codon-optimized UGT85C2
atggatgcaatggcaactactgagaaaaagcctcatgtgatcttcattccatttcctgcacaatctcacataaaggcaatgctaaagttagcacaactattacaccataagggattacagataactttcgtgaataccgacttcatccataatcaatttctggaatctagtggccctcattgtttggacggagccccagggtttagattcgaaacaattcctgacggtgtttcacattccccagaggcctccatcccaataagagagagtttactgaggtcaatagaaaccaactttttggatcgtttcattgacttggtcacaaaacttccagacccaccaacttgcataatctctgatggctttctgtcagtgtttactatcgacgctgccaaaaagttgggtatcccagttatgatgtactggactcttgctgcatgcggtttcatgggtttctatcacatccattctcttatcgaaaagggttttgctccactgaaagatgcatcatacttaaccaacggctacctggatactgttattgactgggtaccaggtatggaaggtataagacttaaagattttcctttggattggtctacagaccttaatgataaagtattgatgtttactacagaagctccacaaagatctcataaggtttcacatcatatctttcacacctttgatgaattggaaccatcaatcatcaaaaccttgtctctaagatacaatcatatctacactattggtccattacaattacttctagatcaaattcctgaagagaaaaagcaaactggtattacatccttacacggctactctttagtgaaagaggaaccagaatgttttcaatggctacaaagtaaagagcctaattctgtggtctacgtcaacttcggaagtacaacagtcatgtccttggaagatatgactgaatttggttggggccttgctaattcaaatcattactttctatggattatcaggtccaatttggtaataggggaaaacgccgtattacctccagaattggaggaacacatcaaaaagagaggtttcattgcttcctggtgttctcaggaaaaggtattgaaacatccttctgttggtggtttccttactcattgcggttggggctctacaatcgaatcactaagtgcaggagttccaatgatttgttggccatattcatgggaccaacttacaaattgtaggtatatctgtaaagagtgggaagttggattagaaatgggaacaaaggttaaacgtgatgaagtgaaaagattggttcaggagttgatgggggaaggtggccacaagatgagaaacaaggccaaagattggaaggaaaaagccagaattgctattgctcctaacgggtcatcctctctaaacattgataagatggtcaaagagattacagtcttagccagaaactaa

SEQ ID NO: 7 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 8 - DNA, 1377 bp, Artificial Sequence
  Codon-optimized UGT76G1
atggaaaacaagaccgaaacaacagttagacgtaggcgtagaatcattctgtttccagtaccttttcaagggcacatcaatccaatactacaactagccaacgttttgtactctaaaggtttttctattacaatctttcacaccaatttcaacaaaccaaaaacatccaattacccacatttcacattcagattcatacttgataatgatccacaagatgaacgtatttcaaacttacctacccacggtcctttagctggaatgagaattccaatcatcaatgaacatggtgccgatgagcttagaagagaattagagttacttatgttggcatccgaagaggacgaggaagtctcttgtctgattactgacgctctatggtactttgcccaatctgtggctgatagtttgaatttgaggagattggtactaatgacatccagtctgtttaactttcacgctcatgttagtttaccacaatttgacgaattgggatacttggaccctgatgacaagactaggttagaggaacaggcctctggttttcctatgttgaaagtcaaagatatcaagtctgcctattctaattggcaaatcttgaaagagatcttaggaaagatgatcaaacagacaaaggcttcatctggagtgatttggaacagtttcaaagagttagaagagtctgaattggagactgtaatcagagaaattccagcaccttcattcctgataccattaccaaaacatttgactgcttcctcttcctctttgttggatcatgacagaacagtttttcaatggttggaccaacaaccacctagttctgttttgtacgtgtcatttggtagtacttctgaagtcgatgaaaaggacttccttgaaatcgcaagaggcttagtcgatagtaagcagtcattcctttgggtcgtgcgtccaggtttcgtgaaaggctcaacatgggtcgaaccacttccagatggttttctaggcgaaagaggtagaatagtcaaatgggttcctcaacaggaagttttagctcatggcgctattggggcattctggactcattccggatggaattcaactttagaatcagtatgcgaaggggtacctatgatcttttcagattttggtcttgatcaaccactgaacgcaagatacatgtctgatgttttgaaagtgggtgtatatctagaaaatggctgggaaaggggtgaaatagctaatgcaataagacgtgttatggttgatgaagagggggagtatatcagacaaaacgcaagagtgctgaagcaaaaggccgacgtttctctaatgaagggaggctcttcatacgaatccttagaatctcttgtttcctacatttcatcactgtaa

SEQ ID NO: 9 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 10 - DNA, 1422 bp, Artificial Sequence
  Codon-optimized UGT91D2e
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcctaa

SEQ ID NO: 11 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 12 - DNA, 1422 bp, Artificial Sequence
  Codon-optimized UGT91D2e-b
atggctacttctgattccatcgttgacgatagaaagcaattgcatgttgctacttttccatggttggctttcggtcatattttgccatacttgcaattgtccaagttgattgctgaaaagggtcacaaggtttcattcttgtctaccaccagaaacatccaaagattgtcctctcatatctccccattgatcaacgttgttcaattgactttgccaagagtccaagaattgccagaagatgctgaagctactactgatgttcatccagaagatatcccttacttgaaaaaggcttccgatggtttacaaccagaagttactagattcttggaacaacattccccagattggatcatctacgattatactcattactggttgccatccattgctgcttcattgggtatttctagagcccatttctctgttactactccatgggctattgcttatatgggtccatctgctgatgctatgattaacggttctgatggtagaactaccgttgaagatttgactactccaccaaagtggtttccatttccaacaaaagtctgttggagaaaacacgatttggctagattggttccatacaaagctccaggtatttctgatggttacagaatgggtatggttttgaaaggttccgattgcttgttgtctaagtgctatcatgaattcggtactcaatggttgcctttgttggaaacattgcatcaagttccagttgttccagtaggtttgttgccaccagaaattccaggtgacgaaaaagacgaaacttgggtttccatcaaaaagtggttggatggtaagcaaaagggttctgttgtttatgttgctttgggttccgaagctttggtttctcaaaccgaagttgttgaattggctttgggtttggaattgtctggtttgccatttgtttgggcttacagaaaacctaaaggtccagctaagtctgattctgttgaattgccagatggtttcgttgaaagaactagagatagaggtttggtttggacttcttgggctccacaattgagaattttgtctcatgaatccgtctgtggtttcttgactcattgtggttctggttctatcgttgaaggtttgatgtttggtcacccattgattatgttgccaatctttggtgaccaaccattgaacgctagattattggaagataagcaagtcggtatcgaaatcccaagaaatgaagaagatggttgcttgaccaaagaatctgttgctagatctttgagatccgttgtcgttgaaaaagaaggtgaaatctacaaggctaacgctagagaattgtccaagatctacaacgataccaaggtcgaaaaagaatacgtttcccaattcgttgactacttggaaaagaatgctagagctgttgccattgatcatgaatcttga

SEQ ID NO: 13 - protein, 473 aa, Artificial Sequence
  UGT91D2e-b
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 14 - DNA, 1389 bp, Oryza sativa
atggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattga

SEQ ID NO: 15 - DNA, 1389 bp, Artificial Sequence
  Codon-optimized EUGT11
atggatagtggctactcctcatcttatgctgctgccgctggtatgcacgttgtgatctgcccttggttggcctttggtcacctgttaccatgtctggatttagcccaaagactggcctcaagaggccatagagtatcatttgtgtctactcctagaaatatctctcgtttaccaccagtcagacctgctctagctcctctagttgcattcgttgctcttccacttccaagagtagaaggattgccagacggcgctgaatctactaatgacgtaccacatgatagacctgacatggtcgaattgcatagaagagcctttgatggattggcagctccattttctgagttcctgggcacagcatgtgcagactgggttatagtcgatgtatttcatcactgggctgctgcagccgcattggaacataaggtgccttgtgctatgatgttgttagggtcagcacacatgatcgcatccatagctgatagaagattggaaagagctgaaacagaatccccagccgcagcaggacaaggtaggccagctgccgccccaacctttgaagtggctagaatgaaattgattcgtactaaaggtagttcagggatgagtcttgctgaaaggttttctctgacattatctagatcatcattagttgtaggtagatcctgcgtcgagttcgaacctgaaacagtacctttactatctactttgagaggcaaacctattactttccttggtctaatgcctccattacatgaaggaaggagagaagatggtgaagatgctactgttaggtggttagatgcccaacctgctaagtctgttgtttacgttgcattgggttctgaggtaccactaggggtggaaaaggtgcatgaattagcattaggacttgagctggccggaacaagattcctttgggctttgagaaaaccaaccggtgtttctgacgccgacttgctaccagctgggttcgaagagagaacaagaggccgtggtgtcgttgctactagatgggtcccacaaatgagtattctagctcatgcagctgtaggggcctttctaacccattgcggttggaactcaacaatagaaggactgatgtttggtcatccacttattatgttaccaatctttggcgatcagggacctaacgcaagattgattgaggcaaagaacgcaggtctgcaggttgcacgtaatgatggtgatggttcctttgatagagaaggcgttgcagctgccatcagagcagtcgccgttgaggaagagtcatctaaagttttccaagctaaggccaaaaaattacaagagattgtggctgacatggcttgtcacgaaagatacatcgatggtttcatccaacaattgagaagttataaagactaa

SEQ ID NO: 16 - protein, 462 aa, Oryza sativa
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 17 - protein, 465 aa, Artificial Sequence
  UGT91D2e-b-EUGT11 chimera 3
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIARNDGDGSFDREGVAAAIRAVAVEEESSKVFQAKAKKLQEIVADMACHERYIDGFIQQLRSYKD

SEQ ID NO: 18 - protein, 470 aa, Artificial Sequence
  UGT91D2e-b-EUGT11 chimera 7
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVPRNEEDGCLTKESVARSLRSVVVEKEGEIYKANARELSKIYNDTKVEKEYVSQFVDYLEKNARAVAIDHES

SEQ ID NO: 19 - DNA, 1086 bp, Artificial Sequence
  Codon-optimized GGPPS
atggctttggtaaacccaaccgctcttttctatggtacctctatcagaacaagacctacaaacttactaaatccaactcaaaagctaagaccagtttcatcatcttccttaccttctttctcatcagttagtgcgattcttactgaaaaacatcaatctaatccttctgagaacaacaatttgcaaactcatctagaaactcctttcaactttgatagttatatgttggaaaaagtcaacatggttaacgaggcgcttgatgcatctgtcccactaaaagacccaatcaaaatccatgaatccatgagatactctttattggcaggcggtaagagaatcagaccaatgatgtgtattgcagcctgcgaaatagtcggaggtaatatccttaacgccatgccagccgcatgtgccgtggaaatgattcatactatgtctttggtgcatgacgatcttccatgtatggataatgatgacttcagaagaggtaaacctatttcacacaaggtctacggggaggaaatggcagtattgaccggcgatgctttactaagtttatctttcgaacatatagctactgctacaaagggtgtatcaaaggatagaatcgtcagagctataggggagttggcccgttcagttggctccgaaggtttagtggctggacaagttgtagatatcttgtcagagggtgctgatgttggattagatcacctagaatacattcacatccacaaaacagcaatgttgcttgagtcctcagtagttattggcgctatcatgggaggaggatctgatcagcagatcgaaaagttgagaaaattcgctagatctattggtctactattccaagttgtggatgacattttggatgttacaaaatctaccgaagagttggggaaaacagctggtaaggatttgttgacagataagacaacttacccaaagttgttaggtatagaaaagtccagagaatttgccgaaaaacttaacaaggaagcacaagagcaattaagtggctttgatagacgtaaggcagctcctttgatcgcgttagccaactacaatgcgtaccgtcaaaattga

SEQ ID NO: 20 - protein, 361 aa, Stevia rebaudiana
MALVNPTALFYGTSIRTRPTNLLNPTQKLRPVSSSSLPSFSSVSAILTEKHQSNPSENNNLQTHLETPFNFDSYMLEKVNMVNEALDASVPLKDPIKIHESMRYSLLAGGKRIRPMMCIAACEIVGGNILNAMPAACAVEMIHTMSLVHDDLPCMDNDDFRRGKPISHKVYGEEMAVLTGDALLSLSFEHIATATKGVSKDRIVRAIGELARSVGSEGLVAGQVVDILSEGADVGLDHLEYIHIHKTAMLLESSVVIGAIMGGGSDQQIEKLRKFARSIGLLFQVVDDILDVTKSTEELGKTAGKDLLTDKTTYPKLLGIEKSREFAEKLNKEAQEQLSGFDRRKAAPLIALANYNAYRQN

SEQ ID NO: 21 - DNA, 1029 bp, Artificial Sequence
  Codon-optimized GGPPS
atggctgagcaacaaatatctaacttgctgtctatgtttgatgcttcacatgctagtcagaaattagaaattactgtccaaatgatggacacataccattacagagaaacgcctccagattcctcatcttctgaaggcggttcattgtctagatacgacgagagaagagtctctttgcctctcagtcataatgctgcctctccagatattgtatcacaactatgtttttccactgcaatgtcttcagagttgaatcacagatggaaatctcaaagattaaaggtggccgattctccttacaactatatcctaacattaccatcaaaaggaattagaggtgcctttatcgattccctgaacgtatggttggaggttccagaggatgaaacatcagtcatcaaggaagttattggtatgctccacaactcttcattaatcattgatgacttccaagataattctccacttagaagaggaaagccatctacccatacagtcttcggccctgcccaggctatcaatactgctacttacgttatagttaaagcaatcgaaaagatacaagacatagtgggacacgatgcattggcagatgttacgggtactattacaactattttccaaggtcaggccatggacttgtggtggacagcaaatgcaatcgttccatcaatacaggaatacttacttatggtaaacgataaaaccggtgctctctttagactgagtttggagttgttagctctgaattccgaagccagtatttctgactctgctttagaaagtttatctagtgctgtttccttgctaggtcaatacttccaaatcagagacgactatatgaacttgatcgataacaagtatacagatcagaaaggcttctgcgaagatcttgatgaaggcaagtactcactaacacttattcatgccctccaaactgattcatccgatctactgaccaacatcctttcaatgagaagagtgcaaggaaagttaacggcacaaaagagatgttggttctggaaatga

SEQ ID NO: 22 - protein, 342 aa, Gibberella fujikuroi
MAEQQISNLLSMFDASHASQKLEITVQMMDTYHYRETPPDSSSSEGGSLSRYDERRVSLPLSHNAASPDIVSQLCFSTAMSSELNHRWKSQRLKVADSPYNYILTLPSKGIRGAFIDSLNVWLEVPEDETSVIKEVIGMLHNSSLIIDDFQDNSPLRRGKPSTHTVFGPAQAINTATYVIVKAIEKIQDIVGHDALADVTGTITTIFQGQAMDLWWTANAIVPSIQEYLLMVNDKTGALFRLSLELLALNSEASISDSALESLSSAVSLLGQYFQIRDDYMNLIDNKYTDQKGFCEDLDEGKYSLTLIHALQTDSSDLLTNILSMRRVQGKLTAQKRCWFWK

SEQ ID NO: 23 - DNA, 903 bp, Artificial Sequence
  Codon-optimized GGPPS
atggaaaagactaaggagaaagcagaacgtatcttgctggagccatacagatacttattacaactaccaggaaagcaagtccgttctaaactatcacaagcgttcaatcactggttaaaagttcctgaagataagttacaaatcattattgaagtcacagaaatgctacacaatgcttctttactgatcgatgatatagaggattcttccaaactgagaagaggttttcctgtcgctcattccatatacggggtaccaagtgtaatcaactcagctaattacgtctacttcttgggattggaaaaagtattgacattagatcatccagacgctgtaaagctattcaccagacaacttcttgaattgcatcaaggtcaaggtttggatatctattggagagacacttatacttgcccaacagaagaggagtacaaagcaatggttctacaaaagactggcggtttgttcggacttgccgttggtctgatgcaacttttctctgattacaaggaggacttaaagcctctgttggataccttgggcttgtttttccagattagagatgactacgctaacttacattcaaaggaatattcagaaaacaaatcattctgtgaagatttgactgaagggaagtttagttttccaacaatccacgccatttggtcaagaccagaatctactcaagtgcaaaacattctgcgtcagagaacagagaatattgacatcaaaaagtattgtgttcagtacttggaagatgttggttcttttgcttacacaagacatacacttagagaattagaggcaaaagcatacaagcaaatagaagcctgtggaggcaatccttctctagtggcattggttaaacatttgtccaaaatgttcaccgaggaaaacaagtaa

SEQ ID NO: 24 - protein, 300 aa, Mus musculus
MEKTKEKAERILLEPYRYLLQLPGKQVRSKLSQAFNHWLKVPEDKLQIIIEVTEMLHNASLLIDDIEDSSKLRRGFPVAHSIYGVPSVINSANYVYFLGLEKVLTLDHPDAVKLFTRQLLELHQGQGLDIYWRDTYTCPTEEEYKAMVLQKTGGLFGLAVGLMQLFSDYKEDLKPLLDTLGLFFQIRDDYANLHSKEYSENKSFCEDLTEGKFSFPTIHAIWSRPESTQVQNILRQRTENIDIKKYCVQYLEDVGSFAYTRHTLRELEAKAYKQIEACGGNPSLVALVKHLSKMFTEENK

SEQ ID NO: 25 - DNA, 1020 bp, Artificial Sequence
  Codon-optimized GGPPS
atggcaagattctattttcttaacgcactattgatggttatctcattacaatcaactacagccttcactccagctaaacttgcttatccaacaacaacaacagctctaaatgtcgcctccgccgaaacttctttcagtctagatgaatacttggcctctaagataggacctatagagtctgccttggaagcatcagtcaaatccagaattccacagaccgataagatctgcgaatctatggcctactctttgatggcaggaggcaagagaattagaccagtgttgtgtatcgctgcatgtgagatgttcggtggatcccaagatgtcgctatgcctactgctgtggcattagaaatgatacacacaatgtctttgattcatgatgatttgccatccatggataacgatgacttgagaagaggtaaaccaacaaaccatgtcgttttcggcgaagatgtagctattcttgcaggtgactctttattgtcaacttccttcgagcacgtcgctagagaaacaaaaggagtgtcagcagaaaagatcgtggatgttatcgctagattaggcaaatctgttggtgccgagggccttgctggcggtcaagttatggacttagaatgtgaagctaaaccaggtaccacattagacgacttgaaatggattcatatccataaaaccgctacattgttacaagttgctgtagcttctggtgcagttctaggtggtgcaactcctgaagaggttgctgcatgcgagttgtttgctatgaatataggtcttgcctttcaagttgccgacgatatccttgatgtaaccgcttcatcagaagatttgggtaaaactgcaggcaaagatgaagctactgataagacaacttacccaaagttattaggattagaagagagtaaggcatacgcaagacaactaatcgatgaagccaaggaaagtttggctccttttggagatagagctgcccctttattggccattgcagatttcattattgatagaaagaattga

SEQ ID NO: 26 - protein, 339 aa, Thalassiosira pseudonana
MARFYFLNALLMVISLQSTTAFTPAKLAYPTTTTALNVASAETSFSLDEYLASKIGPIESALEASVKSRIPQTDKICESMAYSLMAGGKRIRPVLCIAACEMFGGSQDVAMPTAVALEMIHTMSLIHDDLPSMDNDDLRRGKPTNHVVFGEDVAILAGDSLLSTSFEHVARETKGVSAEKIVDVIARLGKSVGAEGLAGGQVMDLECEAKPGTTLDDLKWIHIHKTATLLQVAVASGAVLGGATPEEVAACELFAMNIGLAFQVADDILDVTASSEDLGKTAGKDEATDKTTYPKLLGLEESKAYARQLIDEAKESLAPFGDRAAPLLAIADFIIDRKN

SEQ ID NO: 27 - DNA, 1068 bp, Artificial Sequence
  Codon-optimized GGPPS
atgcacttagcaccacgtagagtccctagaggtagaagatcaccacctgacagagttcctgaaagacaaggtgccttgggtagaagacgtggagctggctctactggctgtgcccgtgctgctgctggtgttcaccgtagaagaggaggaggcgaggctgatccatcagctgctgtgcatagaggctggcaagccggtggtggcaccggtttgcctgatgaggtggtgtctaccgcagccgccttagaaatgtttcatgcttttgctttaatccatgatgatatcatggatgatagtgcaactagaagaggctccccaactgttcacagagccctagctgatcgtttaggcgctgctctggacccagatcaggccggtcaactaggagtttctactgctatcttggttggagatctggctttgacatggtccgatgaattgttatacgctccattgactccacatagactggcagcagtactaccattggtaacagctatgagagctgaaaccgttcatggccaatatcttgatataactagtgctagaagacctgggaccgatacttctcttgcattgagaatagccagatataagacagcagcttacacaatggaacgtccactgcacattggtgcagccctggctggggcaagaccagaactattagcagggctttcagcatacgccttgccagctggagaagccttccaattggcagatgacctgctaggcgtcttcggtgatccaagacgtacagggaaacctgacctagatgatcttagaggtggaaagcatactgtcttagtcgccttggcaagagaacatgccactccagaacagagacacacattggatacattattgggtacaccaggtcttgatagacaaggcgcttcaagactaagatgcgtattggtagcaactggtgcaagagccgaagccgaaagacttattacagagagaagagatcaagcattaactgcattgaacgcattaacactgccacctcctttagctgaggcattagcaagattgacattagggtctacagctcatcctgcctaa

SEQ ID NO: 28 - protein, 355 aa, Streptomyces clavuligerus
MHLAPRRVPRGRRSPPDRVPERQGALGRRRGAGSTGCARAAAGVHRRRGGGEADPSAAVHRGWQAGGGTGLPDEVVSTAAALEMFHAFALIHDDIMDDSATRRGSPTVHRALADRLGAALDPDQAGQLGVSTAILVGDLALTWSDELLYAPLTPHRLAAVLPLVTAMRAETVHGQYLDITSARRPGTDTSLALRIARYKTAAYTMERPLHIGAALAGARPELLAGLSAYALPAGEAFQLADDLLGVFGDPRRTGKPDLDDLRGGKHTVLVALAREHATPEQRHTLDTLLGTPGLDRQGASRLRCVLVATGARAEAERLITERRDQALTALNALTLPPPLAEALARLTLGSTAHPA

SEQ ID NO: 29 - DNA, 993 bp, Artificial Sequence
  Codon-optimized GGPPS
atgtcatatttcgataactacttcaatgagatagttaattccgtgaacgacatcattaagtcttacatctctggcgacgtaccaaaactatacgaagcctcctaccatttgtttacatcaggaggaaagagactaagaccattgatccttacaatttcttctgatcttttcggtggacagagagaaagagcatactatgctggcgcagcaatcgaagttttgcacacattcactttggttcacgatgatatcatggatcaagataacattcgtagaggtcttcctactgtacatgtcaagtatggcctacctttggccattttagctggtgacttattgcatgcaaaagcctttcaattgttgactcaggcattgagaggtctaccatctgaaactatcatcaaggcgtttgatatctttacaagatctatcattatcatatcagaaggtcaagctgtcgatatggaattcgaagatagaattgatatcaaggaacaagagtatttggatatgatatctcgtaaaaccgctgccttattctcagcttcttcttccattggggcgttgatagctggagctaatgataacgatgtgagattaatgtccgatttcggtacaaatcttgggatcgcatttcaaattgtagatgatatacttggtttaacagctgatgaaaaagagctaggaaaacctgttttcagtgatatcagagaaggtaaaaagaccatattagtcattaagactttagaattgtgtaaggaagacgagaaaaagattgtgttaaaagcgctaggcaacaagtcagcatcaaaggaagagttgatgagttctgctgacataatcaaaaagtactcattggattacgcctacaacttagctgagaaatactacaaaaacgccatcgattctctaaatcaagtttcaagtaaaagtgatattccagggaaggcattgaaatatcttgctgaattcaccatcagaagacgtaagtaa

SEQ ID NO: 30 - protein, 330 aa, Sulfolobus acidocaldarius
MSYFDNYFNEIVNSVNDIIKSYISGDVPKLYEASYHLFTSGGKRLRPLILTISSDLFGGQRERAYYAGAAIEVLHTFTLVHDDIMDQDNIRRGLPTVHVKYGLPLAILAGDLLHAKAFQLLTQALRGLPSETIIKAFDIFTRSIIIISEGQAVDMEFEDRIDIKEQEYLDMISRKTAALFSASSSIGALIAGANDNDVRLMSDFGTNLGIAFQIVDDILGLTADEKELGKPVFSDIREGKKTILVIKTLELCKEDEKKIVLKALGNKSASKEELMSSADIIKKYSLDYAYNLAEKYYKNAIDSLNQVSSKSDIPGKALKYLAEFTIRRRK

SEQ ID NO: 31 - DNA, 894 bp, Artificial Sequence
  Codon-optimized GGPPS
atggtcgcacaaactttcaacctggatacctacttatcccaaagacaacaacaagttgaagaggccctaagtgctgctcttgtgccagcttatcctgagagaatatacgaagctatgagatactccctcctggcaggtggcaaaagattaagacctatcttatgtttagctgcttgcgaattggcaggtggttctgttgaacaagccatgccaactgcgtgtgcacttgaaatgatccatacaatgtcactaattcatgatgacctgccagccatggataacgatgatttcagaagaggaaagccaactaatcacaaggtgttcggggaagatatagccatcttagcgggtgatgcgcttttagcttacgcttttgaacatattgcttctcaaacaagaggagtaccacctcaattggtgctacaagttattgctagaatcggacacgccgttgctgcaacaggcctcgttggaggccaagtcgtagaccttgaatctgaaggtaaagctatttccttagaaacattggagtatattcactcacataagactggagccttgctggaagcatcagttgtctcaggcggtattctcgcaggggcagatgaagagcttttggccagattgtctcattacgctagagatataggcttggcttttcaaatcgtcgatgatatcctggatgttactgctacatctgaacagttggggaaaaccgctggtaaagaccaggcagccgcaaaggcaacttatccaagtctattgggtttagaagcctctagacagaaagcggaagagttgattcaatctgctaaggaagccttaagaccttacggttcacaagcagagccactcctagcgctggcagacttcatcacacgtcgtcagcattaa

SEQ ID NO: 32 - protein, 297 aa, Synechococcus sp.
MVAQTFNLDTYLSQRQQQVEEALSAALVPAYPERIYEAMRYSLLAGGKRLRPILCLAACELAGGSVEQAMPTACALEMIHTMSLIHDDLPAMDNDDFRRGKPTNHKVFGEDIAILAGDALLAYAFEHIASQTRGVPPQLVLQVIARIGHAVAATGLVGGQVVDLESEGKAISLETLEYIHSHKTGALLEASVVSGGILAGADEELLARLSHYARDIGLAFQIVDDILDVTATSEQLGKTAGKDQAAAKATYPSLLGLEASRQKAEELIQSAKEALRPYGSQAEPLLALADFITRRQH

SEQ ID NO: 33 - DNA, 1680 bp, Artificial Sequence
  Codon-optimized CDPS
atgaaaaccgggtttatctcaccagcaacagtatttcatcacagaatctcaccagcgaccactttcagacatcacttatcacctgctactacaaactctacaggcattgtcgccttaagagacatcaacttcagatgtaaagcagtttctaaagagtactctgatctgttgcagaaagatgaggcttctttcacaaaatgggacgatgacaaggtgaaagatcatcttgataccaacaaaaacttatacccaaatgatgagattaaggaatttgttgaatcagtaaaggctatgttcggtagtatgaatgacggggagataaacgtctctgcatacgatactgcatgggttgctttggttcaagatgtcgatggatcaggtagtcctcagttcccttcttctttagaatggattgccaacaatcaattgtcagatggatcatggggagatcatttgctgttctcagctcacgatagaatcatcaacacattagcatgcgttattgcacttacaagttggaatgttcatccttctaagtgtgaaaaaggtttgaattttctgagagaaaacatttgcaaattagaagatgaaaacgcagaacatatgccaattggttttgaagtaacattcccatcactaattgatatcgcgaaaaagttgaacattgaagtacctgaggatactccagcacttaaagagatctacgcacgtagagatatcaagttaactaagatcccaatggaagttcttcacaaggtacctactactttgttacattctttggaaggaatgcctgatttggagtgggaaaaactgttaaagctacaatgtaaagatggtagtttcttgttttccccatctagtaccgcattcgccctaatgcaaacaaaagatgagaaatgcttacagtatctaacaaatatcgtcactaagttcaacggtggcgtgcctaatgtgtacccagtcgatttgtttgaacatatttgggttgttgatagactgcagagattggggattgccagatacttcaaatcagagataaaagattgtgtagagtatatcaataagtactggaccaaaaatggaatttgttgggctagaaatactcacgttcaagatatcgatgatacagccatgggattcagagtgttgagagcgcacggttatgacgtcactccagatgtttttagacaatttgaaaaagatggtaaattcgtttgctttgcagggcaatcaacacaagccgtgacaggaatgtttaacgtttacagagcctctcaaatgttgttcccaggggagagaattttggaagatgccaaaaagttctcttacaattacttaaaggaaaagcaaagtaccaacgaattgctggataaatggataatcgctaaagatctacctggtgaagttggttatgctctggatatcccatggtatgcttccttaccaagattggaaactcgttattaccttgaacaatacggcggtgaagatgatgtctggataggcaagacattatacagaatgggttacgtgtccaataacacatatctagaaatggcaaagctggattacaataactatgttgcagtccttcaattagaatggtacacaatacaacaatggtacgtcgatattggtatagagaagttcgaatctgacaacatcaagtcagtcctg

SEQ ID NO: 34 - protein, 787 aa, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 35 - DNA, 1584 bp, Artificial Sequence
  Codon-optimized CDPS
atgcctgatgcacacgatgctccacctccacaaataagacagagaacactagtagatgaggctacccaactgctaactgagtccgcagaagatgcatggggtgaagtcagtgtgtcagaatacgaaacagcaaggctagttgcccatgctacatggttaggtggacacgccacaagagtggccttccttctggagagacaacacgaagacgggtcatggggtccaccaggtggatataggttagtccctacattatctgctgttcacgcattattgacatgtcttgcctctcctgctcaggatcatggcgttccacatgatagacttttaagagctgttgacgcaggcttgactgccttgagaagattggggacatctgactccccacctgatactatagcagttgagctggttatcccatctttgctagagggcattcaacacttactggaccctgctcatcctcatagtagaccagccttctctcaacatagaggctctcttgtttgtcctggtggactagatgggagaactctaggagctttgagatcacacgccgcagcaggtacaccagtaccaggaaaagtctggcacgcttccgagactttgggcttgagtaccgaagctgcttctcacttgcaaccagcccaaggtataatcggtggctctgctgctgccacagcaacatggctaaccagggttgcaccatctcaacagtcagattctgccagaagataccttgaggaattacaacacagatactctggcccagttccttccattacccctatcacatacttcgaaagagcatggttattgaacaattttgcagcagccggtgttccttgtgaggctccagctgctttgttggattccttagaagcagcacttacaccacaaggtgctcctgctggagcaggattgcctccagatgctgatgatacagccgctgtgttgcttgcattggcaacacatgggagaggtagaagaccagaagtactgatggattacaggactgacgggtatttccaatgctttattggggaaaggactccatcaatttcaacaaacgctcacgtattggaaacattagggcatcatgtggcccaacatccacaagatagagccagatacggatcagccatggataccgcatcagcttggctgctggcagctcaaaagcaagatggctcttggttagataaatggcatgcctcaccatactacgctactgtttgttgcacacaagccctagccgctcatgcaagtcctgcaactgcaccagctagacagagagctgtcagatgggttttagccacacaaagatccgatggcggttggggtctatggcattcaactgttgaagagactgcttatgccttacagatcttggccccaccttctggtggtggcaatatcccagtccaacaagcacttactagaggcagagcaagattgtgtggagccttgccactgactcctttatggcatgataaggatttgtatactccagtaagagtagtcagagctgccagagctgctgctctgtacactaccagagatctattgttaccaccattgtaa

SEQ ID NO: 36 - protein, 527 aa, Streptomyces clavuligerus
MPDAHDAPPPQIRQRTLVDEATQLLTESAEDAWGEVSVSEYETARLVAHATWLGGHATRVAFLLERQHEDGSWGPPGGYRLVPTLSAVHALLTCLASPAQDHGVPHDRLLRAVDAGLTALRRLGTSDSPPDTIAVELVIPSLLEGIQHLLDPAHPHSRPAFSQHRGSLVCPGGLDGRTLGALRSHAAAGTPVPGKVWHASETLGLSTEAASHLQPAQGIIGGSAAATATWLTRVAPSQQSDSARRYLEELQHRYSGPVPSITPITYFERAWLLNNFAAAGVPCEAPAALLDSLEAALTPQGAPAGAGLPPDADDTAAVLLALATHGRGRRPEVLMDYRTDGYFQCFIGERTPSISTNAHVLETLGHHVAQHPQDRARYGSAMDTASAWLLAAQKQDGSWLDKWHASPYYATVCCTQALAAHASPATAPARQRAVRWVLATQRSDGGWGLWHSTVEETAYALQILAPPSGGGNIPVQQALTRGRARLCGALPLTPLWHDKDLYTPVRVVRAARAAALYTTRDLLLPPL

SEQ ID NO: 37 - DNA, 1551 bp, Artificial Sequence
  Codon-optimized CDPS
atgaacgccctatccgaacacattttgtctgaattgagaagattattgtctgaaatgagtgatggcggatctgttggtccatctgtgtatgatacggcccaggccctaagattccacggtaacgtaacaggtagacaagatgcatatgcttggttgatcgcccagcaacaagcagatggaggttggggctctgccgactttccactctttagacatgctccaacatgggctgcacttctcgcattacaaagagctgatccacttcctggcgcagcagacgcagttcagaccgcaacaagattcttgcaaagacaaccagatccatacgctcatgccgttcctgaggatgcccctattggtgctgaactgatcttgcctcagttttgtggagaggctgcttggttgttgggaggtgtggccttccctagacacccagccctattaccattaagacaggcttgtttagtcaaactgggtgcagtcgccatgttgccttcaggacacccattgctccactcctgggaggcatggggtacttctccaacaacagcctgtccagacgatgatggttctataggtatctcaccagcagctacagccgcctggagagcccaggctgtgaccagaggctcaactcctcaagtgggcagagctgacgcatacttacaaatggcttcaagagcaacgagatcaggcatagaaggagtcttccctaatgtttggcctataaacgtattcgaaccatgctggtcactgtacactctccatcttgccggtctgttcgcccatccagcactggctgaggctgtaagagttatcgttgctcaacttgaagcaagattgggagtgcatggcctcggaccagctttacattttgctgccgacgctgatgatactgcagttgccttatgcgttctgcatttggctggcagagatcctgcagttgacgcattgagacattttgaaattggtgagctctttgttacattcccaggagagagaaatgctagtgtctctacgaacattcacgctcttcatgctttgagattgttaggtaaaccagctgccggagcaagtgcatacgtcgaagcaaatagaaatccacatggtttgtgggacaacgaaaaatggcacgtttcatggctttatccaactgcacacgccgttgcagctctagctcaaggcaagcctcaatggagagatgaaagagcactagccgctctactacaagctcaaagagatgatggtggttggggagctggtagaggatccactttcgaggaaaccgcctacgctcttttcgctttacacgttatggacggatctgaggaagccacaggcagaagaagaatcgctcaagtcgtcgcaagagccttagaatggatgctagctagacatgccgcacatggattaccacaaacaccactctggattggtaaggaattgtactgtcctactagagtcgtaagagtagctgagctagctggcctgtggttagcattaagatggggtagaagagtattagctgaaggtgctggtgctgcaccttaa

SEQ ID NO: 38 - protein, 516 aa, Bradyrhizobium japonicum
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAAWLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLEARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 39 - DNA, 2490 bp, Artificial Sequence
  Codon-optimized CDPS
atggttttgtcttcttcttgtactacagtaccacacttatcttcattagctgtcgtgcaacttggtccttggagcagtaggattaaaaagaaaaccgatactgttgcagtaccagccgctgcaggaaggtggagaagggccttggctagagcacagcacacatcagaatccgcagctgtcgcaaagggcagcagtttgacccctatagtgagaactgacgctgagtcaaggagaacaagatggccaaccgatgacgatgacgccgaacctttagtggatgagatcagggcaatgcttacttccatgtctgatggtgacatttccgtgagcgcatacgatacagcctgggtcggattggttccaagattagacggcggtgaaggtcctcaatttccagcagctgtgagatggataagaaataaccagttgcctgacggaagttggggcgatgccgcattattctctgcctatgacaggcttatcaatacccttgcctgcgttgtaactttgacaaggtggtccctagaaccagagatgagaggtagaggactatcttttttgggtaggaacatgtggaaattagcaactgaagatgaagagtcaatgcctattggcttcgaattagcatttccatctttgatagagcttgctaagagcctaggtgtccatgacttcccttatgatcaccaggccctacaaggaatctactcttcaagagagatcaaaatgaagaggattccaaaagaagtgatgcataccgttccaacatcaatattgcacagtttggagggtatgcctggcctagattgggctaaactacttaaactacagagcagcgacggaagttttttgttctcaccagctgccactgcatatgctttaatgaataccggagatgacaggtgttttagctacatcgatagaacagtaaagaaattcaacggcggcgtccctaatgtttatccagtggatctatttgaacatatttgggccgttgatagacttgaaagattaggaatctccaggtacttccaaaaggagatcgaacaatgcatggattatgtaaacaggcattggactgaggacggtatttgttgggcaaggaactctgatgtcaaagaggtggacgacacagctatggcctttagacttcttaggttgcacggctacagcgtcagtcctgatgtgtttaaaaacttcgaaaaggacggtgaatttttcgcatttgtcggacagtctaatcaagctgttaccggtatgtacaacttaaacagagcaagccagatatccttcccaggcgaggatgtgcttcatagagctggtgccttctcatatgagttcttgaggagaaaagaagcagagggagctttgagggacaagtggatcatttctaaagatctacctggtgaagttgtgtatactttggattttccatggtacggcaacttacctagagtcgaggccagagactacctagagcaatacggaggtggtgatgacgtttggattggcaagacattgtataggatgccacttgtaaacaatgatgtatatttggaattggcaagaatggatttcaaccactgccaggctttgcatcagttagagtggcaaggactaaaaagatggtatactgaaaataggttgatggactttggtgtcgcccaagaagatgcccttagagcttattttcttgcagccgcatctgtttacgagccttgtagagctgccgagaggcttgcatgggctagagccgcaatactagctaacgccgtgagcacccacttaagaaatagcccatcattcagagaaaggttagagcattctcttaggtgtagacctagtgaagagacagatggctcctggtttaactcctcaagtggctctgatgcagttttagtaaaggctgtcttaagacttactgattcattagccagggaagcacagccaatccatggaggtgacccagaagatattatacacaagttgttaagatctgcttgggccgagtgggttagggaaaaggcagacgctgccgatagcgtgtgcaatggtagttctgcagtagaacaagagggatcaagaatggtccatgataaacagacctgtctattattggctagaatgatcgaaatttctgccggtagggcagctggtgaagcagccagtgaggacggcgatagaagaataattcaattaacaggctccatctgcgacagtcttaagcaaaaaatgctagtttcacaggaccctgaaaaaaatgaagagatgatgtctcacgtggatgacgaattgaagttgaggattagagagttcgttcaatatttgcttagactaggtgaaaaaaagactggatctagcgaaaccaggcaaacatttttaagtatagtgaaatcatgttactatgctgctcattgcccacctcatgtcgttgatagacacattagtagagtgattttcgagccagtaagtgccgcaaagtaaccgcgg

SEQ ID NO: 40 - protein, 827 aa, Zea mays
MVLSSSCTTVPHLSSLAVVQLGPWSSRIKKKTDTVAVPAAAGRWRRALARAQHTSESAAVAKGSSLTPIVRTDAESRRTRWPTDDDDAEPLVDEIRAMLTSMSDGDISVSAYDTAWVGLVPRLDGGEGPQFPAAVRWIRNNQLPDGSWGDAALFSAYDRLINTLACVVTLTRWSLEPEMRGRGLSFLGRNMWKLATEDEESMPIGFELAFPSLIELAKSLGVHDFPYDHQALQGIYSSREIKMKRIPKEVMHTVPTSILHSLEGMPGLDWAKLLKLQSSDGSFLFSPAATAYALMNTGDDRCFSYIDRTVKKFNGGVPNVYPVDLFEHIWAVDRLERLGISRYFQKEIEQCMDYVNRHWTEDGICWARNSDVKEVDDTAMAFRLLRLHGYSVSPDVFKNFEKDGEFFAFVGQSNQAVTGMYNLNRASQISFPGEDVLHRAGAFSYEFLRRKEAEGALRDKWIISKDLPGEVVYTLDFPWYGNLPRVEARDYLEQYGGGDDVWIGKTLYRMPLVNNDVYLELARMDFNHCQALHQLEWQGLKRWYTENRLMDFGVAQEDALRAYFLAAASVYEPCRAAERLAWARAAILANAVSTHLRNSPSFRERLEHSLRCRPSEETDGSWFNSSSGSDAVLVKAVLRLTDSLAREAQPIHGGDPEDIIHKLLRSAWAEWVREKADAADSVCNGSSAVEQEGSRMVHDKQTCLLLARMIEISAGRAAGEAASEDGDRRIIQLTGSICDSLKQKMLVSQDPEKNEEMMSHVDDELKLRIREFVQYLLRLGEKKTGSSETRQTFLSIVKSCYYAAHCPPHVVDRHISRVIFEPVSAAK

SEQ ID NO: 41 - DNA, 2570 bp, Artificial Sequence
  Codon-optimized CDPS
cttcttcactaaatacttagacagagaaaacagagctttttaaagccatgtctcttcagtatcatgttctaaactccattccaagtacaacctttctcagttctactaaaacaacaatatcttcttctttccttaccatctcaggatctcctctcaatgtcgctagagacaaatccagaagcggttccatacattgttcaaagcttcgaactcaagaatacattaattctcaagaggttcaacatgatttgcctctaatacatgagtggcaacagcttcaaggagaagatgctcctcagattagtgttggaagtaatagtaatgcattcaaagaagcagtgaagagtgtgaaaacgatcttgagaaacctaacggacggggaaattacgatatcggcttacgatacagcttgggttgcattgatcgatgccggagataaaactccggcgtttccctccgccgtgaaatggatcgccgagaaccaactttccgatggttcttggggagatgcgtatctcttctcttatcatgatcgtctcatcaatacccttgcatgcgtcgttgctctaagatcatggaatctctttcctcatcaatgcaacaaaggaatcacgtttttccgggaaaatattgggaagctagaagacgaaaatgatgagcatatgccaatcggattcgaagtagcattcccatcgttgcttgagatagctcgaggaataaacattgatgtaccgtacgattctccggtcttaaaagatatatacgccaagaaagagctaaagcttacaaggataccaaaagagataatgcacaagataccaacaacattgttgcatagtttggaggggatgcgtgatttagattgggaaaagctcttgaaacttcaatctcaagacggatctttcctcttctctccttcctctaccgcttttgcattcatgcagacccgagacagtaactgcctcgagtatttgcgaaatgccgtcaaacgtttcaatggaggagttcccaatgtctttcccgtggatcttttcgagcacatatggatagtggatcggttacaacgtttagggatatcgagatactttgaagaagagattaaagagtgtcttgactatgtccacagatattggaccgacaatggcatatgttgggctagatgttcccatgtccaagacatcgatgatacagccatggcatttaggctcttaagacaacatggataccaagtgtccgcagatgtattcaagaactttgagaaagagggagagtttttctgctttgtggggcaatcaaaccaagcagtaaccggtatgttcaacctataccgggcatcacaattggcgtttccaagggaagagatattgaaaaacgccaaagagttttcttataattatctgctagaaaaacgggagagagaggagttgattgataagtggattataatgaaagacttacctggcgagattgggtttgcgttagagattccatggtacgcaagcttgcctcgagtagagacgagattctatattgatcaatatggtggagaaaacgacgtttggattggcaagactctttataggatgccatacgtgaacaataatggatatctggaattagcaaaacaagattacaacaattgccaagctcagcatcagctcgaatgggacatattccaaaagtggtatgaagaaaataggttaagtgagtggggtgtgcgcagaagtgagcttctcgagtgttactacttagcggctgcaactatatttgaatcagaaaggtcacatgagagaatggtttgggctaagtcaagtgtattggttaaagccatttcttcttcttttggggaatcctctgactccagaagaagcttctccgatcagtttcatgaatacattgccaatgctcgacgaagtgatcatcactttaatgacaggaacatgagattggaccgaccaggatcggttcaggccagtcggcttgccggagtgttaatcgggactttgaatcaaatgtcttttgaccttttcatgtctcatggccgtgacgttaacaatctcctctatctatcgtggggagattggatggaaaaatggaaactatatggagatgaaggagaaggagagctcatggtgaagatgataattctaatgaagaacaatgacctaactaacttcttcacccacactcacttcgttcgtctcgcggaaatcatcaatcgaatctgtcttcctcgccaatacttaaaggcaaggagaaacgatgagaaggagaagacaataaagagtatggagaaggagatggggaaaatggttgagttagcattgtcggagagtgacacatttcgtgacgtcagcatcacgtttcttgatgtagcaaaagcattttactactttgctttatgtggcgatcatctccaaactcacatctccaaagtcttgtttcaaaaagtctagtaacctcatcatcatcatcgatccattaacaatcagtggatcgatgtatccatagatgcgtgaataatatttcatgtagagaaggagaacaaattagatcatgtagggttatca

SEQ ID NO: 42 - protein, 802 aa, Arabidopsis thaliana
MSLQYHVLNSIPSTTFLSSTKTTISSSFLTISGSPLNVARDKSRSGSIHCSKLRTQEYINSQEVQHDLPLIHEWQQLQGEDAPQISVGSNSNAFKEAVKSVKTILRNLTDGEITISAYDTAWVALIDAGDKTPAFPSAVKWIAENQLSDGSWGDAYLFSYHDRLINTLACVVALRSWNLFPHQCNKGITFFRENIGKLEDENDEHMPIGFEVAFPSLLEIARGINIDVPYDSPVLKDIYAKKELKLTRIPKEIMHKIPTTLLHSLEGMRDLDWEKLLKLQSQDGSFLFSPSSTAFAFMQTRDSNCLEYLRNAVKRFNGGVPNVFPVDLFEHIWIVDRLQRLGISRYFEEEIKECLDYVHRYWTDNGICWARCSHVQDIDDTAMAFRLLRQHGYQVSADVFKNFEKEGEFFCFVGQSNQAVTGMFNLYRASQLAFPREEILKNAKEFSYNYLLEKREREELIDKWIIMKDLPGEIGFALEIPWYASLPRVETRFYIDQYGGENDVWIGKTLYRMPYVNNNGYLELAKQDYNNCQAQHQLEWDIFQKWYEENRLSEWGVRRSELLECYYLAAATIFESERSHERMVWAKSSVLVKAISSSFGESSDSRRSFSDQFHEYIANARRSDHHFNDRNMRLDRPGSVQASRLAGVLIGTLNQMSFDLFMSHGRDVNNLLYLSWGDWMEKWKLYGDEGEGELMVKMIILMKNNDLTNFFTHTHFVRLAEIINRICLPRQYLKARRNDEKEKTIKSMEKEMGKMVELALSESDTFRDVSITFLDVAKAFYYFALCGDHLQTHISKVLFQKV

SEQ ID NO: 43 - DNA, 2355 bp, Artificial Sequence
  Codon-optimized KS
atgaatttgagtttgtgtatagcatctccactattgaccaaatctaatagaccagctgctttatcagcaattcatacagctagtacatcccatggtggccaaaccaaccctacgaatctgataatcgatacgaccaaggagagaatacaaaaacaattcaaaaatgttgaaatttcagtttcttcttatgatactgcgtgggttgccatggttccatcacctaattctccaaagtctccatgtttcccagaatgtttgaattggctgattaacaaccagttgaatgatggatcttggggtttagtcaatcacacgcacaatcacaaccatccacttttgaaagattctttatcctcaactttggcttgcatcgtggccctaaagagatggaacgtaggtgaggatcagattaacaaggggcttagtttcattgaatctaacttggcttccgcgactgaaaaatctcaaccatctccaataggattcgatatcatctttccaggtctgttagagtacgccaaaaatctagatatcaacttactgtctaagcaaactgatttctcactaatgttacacaagagagaattagaacaaaagagatgtcattcaaacgaaatggatggttacctagcttatatctctgaaggtcttggtaatctttacgattggaatatggtgaaaaagtaccagatgaaaaatggctcagttttcaattccccttctgcaactgcggcagcattcattaaccatcaaaatccaggatgcctgaactatttgaattcactactagacaaattcggcaacgcagttccaactgtataccctcacgatttgtttatcagattgagtatggtggatacaattgaaagacttggtatatcccaccactttagagtcgagatcaaaaatgttttggatgagacataccgttgttgggtggagagagatgaacaaatctttatggatgttgtgacgtgcgcgttggcctttagattgttgcgtattaacggttacgaagttagtccagatccacttgccgaaattacaaacgaattagctttaaaggatgaatacgccgctcttgaaacatatcatgcgtcacatatcctttaccaagaggacttatcatctggaaaacaaattcttaaatctgctgatttcctgaaggaaatcatatccactgatagtaatagactgtccaaactgatccataaagaggttgaaaatgcacttaagttccctattaacaccggcttagaacgtattaacacaagacgtaacatccagctttacaacgtagacaatactagaatcttgaaaaccacttaccattcttccaacatatcaaacactgattacctaagattagctgttgaagatttctacacatgtcagtctatctatagagaagagctgaaaggattagagagatgggtcgttgagaataagctagatcaattgaaatttgccagacaaaagacagcttattgttacttctcagttgccgccactttatcaagtccagaattgtcagatgcacgtatttcttgggctaaaaacggaattttgacaactgttgttgatgatttctttgatattggcgggacaatcgacgaattgacaaacctgattcaatgcgttgaaaagtggaatgtcgatgtcgataaagactgttgctcagaacatgttagaatactgttcttggctctgaaagatgctatctgttggatcggggatgaggctttcaaatggcaagctagagatgtgacgtctcacgtcattcaaacctggctagaactgatgaactctatgttgagagaagcaatttggactagagatgcatacgttcctacattaaacgagtatatggaaaacgcttatgtctcctttgctttgggtcctatcgttaagcctgccatatactttgtaggaccaaagctatccgaggaaatcgtcgaatcatcagaataccataacttgttcaagttaatgtccacacaaggcagattacttaatgatattcattctttcaaaagagagtttaaggaaggaaagttaaatgctgttgctctgcatctttctaatggcgaaagtggtaaagtcgaagaggaagtagttgaggaaatgatgatgatgatcaaaaacaagagaaaggagttgatgaaactaatcttcgaagagaacggttcaattgttcctagagcatgtaaggatgcattttggaacatgtgtcatgtgctaaactttttctacgcaaacgacgatggttttactgggaacacaatactagatacagtaaaagacatcatatacaaccctttggtcttagtaaacgaaaacgaggagcaaagataa

SEQ ID NO: 44 - protein, 784 aa, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 45 - DNA, 2355 bp, Artificial Sequence
  Codon-optimized KS
atgaatctgtccctttgtatagctagtccactgttgacaaaatcttctagaccaactgctctttctgcaattcatactgccagtactagtcatggaggtcaaacaaacccaacaaatttgataatcgatactactaaggagagaatccaaaagctattcaaaaatgttgaaatctcagtatcatcttatgacaccgcatgggttgcaatggtgccatcacctaattccccaaaaagtccatgttttccagagtgcttgaattggttaatcaataatcagttaaacgatggttcttggggtttagtcaaccacactcataaccacaatcatccattattgaaggactctttatcatcaacattagcctgtattgttgcattgaaaagatggaatgtaggtgaagatcaaatcaacaagggtttatcattcatagaatccaatctagcttctgctaccgacaaatcacaaccatctccaatcgggttcgacataatcttccctggtttgctggagtatgccaaaaaccttgatatcaacttactgtctaaacaaacagatttctctttgatgctacacaaaagagagttagagcagaaaagatgccattctaacgaaattgacgggtacttagcatatatctcagaaggtttgggtaatttgtatgactggaacatggtcaaaaagtatcagatgaaaaatggatccgtattcaattctccttctgcaactgccgcagcattcattaatcatcaaaaccctgggtgtcttaactacttgaactcactattagataagtttggaaatgcagttccaacagtctatcctttggacttgtacatcagattatctatggttgacactatagagagattaggtatttctcatcatttcagagttgagatcaaaaatgttttggacgagacatacagatgttgggtcgaaagagatgagcaaatctttatggatgtcgtgacctgcgctctggcttttagattgctaaggatacacggatacaaagtatctcctgatcaactggctgagattacaaacgaactggctttcaaagacgaatacgccgcattagaaacataccatgcatcccaaatactttaccaggaagacctaagttcaggaaaacaaatcttgaagtctgcagatttcctgaaaggcattctgtctacagatagtaataggttgtctaaattgatacacaaggaagtagaaaacgcactaaagtttcctattaacactggtttagagagaatcaatactaggagaaacattcagctgtacaacgtagataatacaaggattcttaagaccacctaccatagttcaaacatttccaacacctattacttaagattagctgtcgaagacttttacacttgtcaatcaatctacagagaggagttaaagggcctagaaagatgggtagttcaaaacaagttggatcaactgaagtttgctagacagaagacagcatactgttatttctctgttgctgctaccctttcatccccagaattgtctgatgccagaataagttgggccaaaaatggtattcttacaactgtagtcgatgatttctttgatattggaggtactattgatgaactgacaaatcttattcaatgtgttgaaaagtggaacgtggatgtagataaggattgctgcagtgaacatgtgagaatacttttcctggctctaaaagatgcaatatgttggattggcgacgaggccttcaagtggcaagctagagatgttacatctcatgtcatccaaacttggcttgaactgatgaactcaatgctaagagaagcaatctggacaagagatgcatacgttccaacattgaacgaatacatggaaaacgcttacgtctcatttgccttgggtcctattgttaagccagccatatactttgttgggccaaagttatccgaagagattgttgagtcttccgaatatcataacctattcaagttaatgtcaacacaaggcagacttctgaacgatatccactccttcaaaagagaattcaaggaaggtaagctaaacgctgttgctttgcacttgtctaatggtgaatctggcaaagtggaagaggaagtcgttgaggaaatgatgatgatgatcaaaaacaagagaaaggaattgatgaaattgattttcgaggaaaatggttcaatcgtacctagagcttgtaaagatgctttttggaatatgtgccatgttcttaacttcttttacgctaatgatgatggcttcactggaaatacaatattggatacagttaaagatatcatctacaacccacttgttttggtcaatgagaacgaggaacaaagataa

SEQ ID NO: 46 - protein, 784 aa, Stevia rebaudiana
MNLSLCIASPLLTKSSRPTALSAIHTASTSHGGQTNPTNLIIDTTKERIQKLFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATDKSQPSPIGFDIIFPGLLEYAKNLDINLLSKQTDFSLMLHKRELEQKRCHSNEIDGYLAYISEGLGNLYDWNMVKKYQMKNGSVFNSPSATAAAFINHQNPGCLNYLNSLLDKFGNAVPTVYPLDLYIRLSMVDTIERLGISHHFRVEIKNVLDETYRCWVERDEQIFMDVVTCALAFRLLRIHGYKVSPDQLAEITNELAFKDEYAALETYHASQILYQEDLSSGKQILKSADFLKGILSTDSNRLSKLIHKEVENALKFPINTGLERINTRRNIQLYNVDNTRILKTTYHSSNISNTYYLRLAVEDFYTCQSIYREELKGLERWVVQNKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 47 - DNA, 1773 bp, Artificial Sequence
  Codon-optimized KS
atggctatgccagtgaagctaacacctgcgtcattatccttaaaagctgtgtgctgcagattctcatccggtggccatgctttgagattcgggagtagtctgccatgttggagaaggacccctacccaaagatctacttcttcctctactactagaccagctgccgaagtgtcatcaggtaagagtaaacaacatgatcaggaagctagtgaagcgactatcagacaacaattacaacttgtggatgtcctggagaatatgggaatatccagacattttgctgcagagataaagtgcatactagacagaacttacagatcttggttacaaagacacgaggaaatcatgctggacactatgacatgtgctatggcttttagaatcctaagattgaacggatacaacgtttcatcagatgaactataccacgttgtagaggcatctggtctgcataattctttgggtgggtatcttaacgataccagaacactacttgaattacacaaggcttcaacagttagtatctctgaggatgaatctatcttagattcaattggctctagatccagaacattgcttagagaacaattggagtctggtggcgcactgagaaagccttctttattcaaagaggttgaacatgcactggatggacctttttacaccacacttgatagacttcatcataggtggaatattgaaaacttcaacattattgagcaacacatgttggagactccatacttatctaaccagcatacatcaagggatatcctagcattgtcaattagagatttttcctcctcacaattcacttatcaacaagagctacagcatctggagagttgggttaaggaatgtagattagatcaactacagttcgcaagacagaaattagcgtacttttacctatcagccgcaggcaccatgttttctcctgagctttctgatgcgagaacattatgggccaaaaacggggtgttgacaactattgttgatgatttctttgatgttgccggttctaaagaggaattggaaaacttagtcatgctggtcgaaatgtgggatgaacatcacaaagttgaattctattctgagcaggtcgaaatcatcttctcttccatctacgattctgtcaaccaattgggtgagaaggcctctttggttcaagacagatcaattacaaaacaccttgttgaaatatggttagacttgttaaagtccatgatgacggaagttgaatggagactgtcaaaatacgtgcctacagaaaaggaatacatgattaatgcctctcttatcttcggcctaggtccaatcgttttaccagctttgtatttcgttggtccaaagatttcagaaagtatagtaaaggacccagaatatgatgaattgttcaaactaatgtcaacatgtggtagattgttgaatgacgtgcaaacgttcgaaagagaatacaatgagggtaaactgaattctgtcagtctattggttcttcacggaggcccaatgtctatttcagacgcaaagaggaaattacaaaagcctattgatacgtgtagaagagatcttctttctttggtccttagagaagagtctgtagtaccaagaccatgtaaggaactattctggaaaatgtgtaaagtgtgctatttcttttactcaacaactgatgggttttctagtcaagtcgaaagagcaaaagaggtagacgctgtcataaatgagccactgaagttgcaaggttctcatacactggtatctgatgtttaa

SEQ ID NO: 48 - protein, 590 aa, Zea mays
MAMPVKLTPASLSLKAVCCRFSSGGHALRFGSSLPCWRRTPTQRSTSSSTTRPAAEVSSGKSKQHDQEASEATIRQQLQLVDVLENMGISRHFAAEIKCILDRTYRSWLQRHEEIMLDTMTCAMAFRILRLNGYNVSSDELYHVVEASGLHNSLGGYLNDTRTLLELHKASTVSISEDESILDSIGSRSRTLLREQLESGGALRKPSLFKEVEHALDGPFYTTLDRLHHRWNIENFNIIEQHMLETPYLSNQHTSRDILALSIRDFSSSQFTYQQELQHLESWVKECRLDQLQFARQKLAYFYLSAAGTMFSPELSDARTLWAKNGVLTTIVDDFFDVAGSKEELENLVMLVEMWDEHHKVEFYSEQVEIIFSSIYDSVNQLGEKASLVQDRSITKHLVEIWLDLLKSMMTEVEWRLSKYVPTEKEYMINASLIFGLGPIVLPALYFVGPKISESIVKDPEYDELFKLMSTCGRLLNDVQTFEREYNEGKLNSVSLLVLHGGPMSISDAKRKLQKPIDTCRRDLLSLVLREESVVPRPCKELFWKMCKVCYFFYSTTDGFSSQVERAKEVDAVINEPLKLQGSHTLVSDV

SEQ ID NO: 49 - DNA, 2232 bp, Artificial Sequence
  Codon-optimized KS
atgcagaacttccatggtacaaaggaaaggatcaaaaagatgtttgacaagattgaattgtccgtttcttcttatgatacagcctgggttgcaatggtcccatcccctgattgcccagaaacaccttgttttccagaatgtactaaatggatcctagaaaatcagttgggtgatggtagttggtcacttcctcatggcaatccacttctagttaaagatgcattatcttccactcttgcttgtattctggctcttaaaagatggggaatcggtgaggaacagattaacaaaggactgagattcatagaactcaactctgctagtgtaaccgataacgaacaacacaaaccaattggatttgacattatctttccaggtatgattgaatacgctatagacttagacctgaatctaccactaaaaccaactgacattaactccatgttgcatcgtagagcccttgaattgacatcaggtggaggcaaaaatctagaaggtagaagagcttacttggcctacgtctctgaaggaatcggtaagctgcaagattgggaaatggctatgaaataccaacgtaaaaacggatctctgttcaatagtccatcaacaactgcagctgcattcatccatatacaagatgctgaatgcctccactatattcgttctcttctccagaaatttggaaacgcagtccctacaatataccctctcgatatctatgccagactttcaatggtagatgccctggaacgtcttggtattgatagacatttcagaaaggagagaaagttcgttctggatgaaacatacagattttggttgcaaggagaagaggagattttctccgataacgcaacctgtgctttggccttcagaatattgagacttaatggttacgatgtctctcttgaagatcacttctctaactctctgggcggttacttaaaggactcaggagcagctttagaactgtacagagccctccaattgtcttacccagacgagtccctcctggaaaagcaaaattctagaacttcttacttcttaaaacaaggtttatccaatgtctccctctgtggtgacagattgcgtaaaaacataattggagaggtgcatgatgctttaaacttttccgaccacgctaacttacaaagattagctattcgtagaaggattaagcattacgctactgacgatacaaggattctaaaaacttcctacagatgctcaacaatcggtaaccaagattttctaaaacttgcagtggaagatttcaatatctgtcaatcaatacaaagagaggaattcaagcatattgaaagatgggtcgttgaaagacgtctagacaagttaaagttcgctagacaaaaagaggcctattgctatttctcagccgcagcaacattgtttgcccctgaattgtctgatgctagaatgtcttgggccaaaaatggtgtattgacaactgtggttgatgatttcttcgatgtcggaggctctgaagaggaattagttaacttgatagaattgatcgagcgttgggatgtgaatggcagtgcagatttttgtagtgaggaagttgagattatctattctgctatccactcaactatctctgaaataggtgataagtcatttggctggcaaggtagagatgtaaagtctcaagttatcaagatctggctggacttattgaaatcaatgttaactgaagctcaatggtcttcaaacaagtctgttcctaccctagatgagtatatgacaaccgcccatgtttcattcgcacttggtccaattgtacttccagccttatacttcgttggcccaaagttgtcagaagaggttgcaggtcatcctgaactactaaacctctacaaagtcacatctacttgtggcagactactgaatgattggagaagttttaagagagaatccgaggaaggtaagctcaacgctattagtttatacatgatccactccggtggtgcttctacagaagaggaaacaatcgaacatttcaaaggtttgattgattctcagagaaggcaactgttacaattggtgttgcaagagaaggatagtatcatacctagaccatgtaaagatctattttggaatatgattaagttattacacactttctacatgaaagatgatggcttcacctcaaatgagatgaggaatgtagttaaggcaatcattaacgaaccaatctcactggatgaattatga

SEQ ID NO: 50 - protein, 775 aa, Populus trichocarpa
MSCIRPWFCPSSISATLTDPASKLVTGEFKTTSLNFHGTKERIKKMFDKIELSVSSYDTAWVAMVPSPDCPETPCFPECTKWILENQLGDGSWSLPHGNPLLVKDALSSTLACILALKRWGIGEEQINKGLRFIELNSASVTDNEQHKPIGFDIIFPGMIEYAKDLDLNLPLKPTDINSMLHRRALELTSGGGKNLEGRRAYLAYVSEGIGKLQDWEMAMKYQRKNGSLFNSPSTTAAAFIHIQDAECLHYIRSLLQKFGNAVPTIYPLDIYARLSMVDALERLGIDRHFRKERKFVLDETYRFWLQGEEEIFSDNATCALAFRILRLNGYDVSLEDHFSNSLGGYLKDSGAALELYRALQLSYPDESLLEKQNSRTSYFLKQGLSNVSLCGDRLRKNIIGEVHDALNFPDHANLQRLAIRRRIKHYATDDTRILKTSYRCSTIGNQDFLKLAVEDFNICQSIQREEFKHIERWVVERRLDKLKFARQKEAYCYFSAAATLFAPELSDARMSWAKNGVLTTVVDDFFDVGGSEEELVNLIELIERWDVNGSADFCSEEVEIIYSAIHSTISEIGDKSFGWQGRDVKSHVIKIWLDLLKSMLTEAQWSSNKSVPTLDEYMTTAHVSFALGPIVLPALYFVGPKLSEEVAGHPELLNLYKVMSTCGRLLNDWRSFKRESEEGKLNAISLYMIHSGGASTEEETIEHFKGLIDSQRRQLLQLVLQEKDSIIPRPCKDLFWNMIKLLHTFYMKDDGFTSNEMRNVVKAIINEPISLDEL

SEQ ID NO: 51 - DNA, 2358 bp, Artificial Sequence
  Codon-optimized KS
atgtctatcaaccttcgctcctccggttgttcgtctccgatctcagctactttggaacgaggattggactcagaagtacagacaagagctaacaatgtgagctttgagcaaacaaaggagaagattaggaagatgttggagaaagtggagctttctgtttcggcctacgatactagttgggtagcaatggttccatcaccgagctcccaaaatgctccacttttcccacagtgtgtgaaatggttattggataatcaacatgaagatggatcttggggacttgataaccatgaccatcaatctcttaagaaggatgtgttatcatctacactggctagtatcctcgcgttaaagaagtggggaattggtgaaagacaaataaacaagggtctccagtttattgagctgaattctgcattagtcactgatgaaaccatacagaaaccaacagggtttgatattatatttcctgggatgattaaatatgctagagatttgaatctgacgattccattgggctcagaagtggtggatgacatgatacgaaaaagagatctggatcttaaatgtgatagtgaaaagttttcaaagggaagagaagcatatctggcctatgttttagaggggacaagaaacctaaaagattgggatttgatagtcaaatatcaaaggaaaaatgggtcactgtttgattctccagccacaacagcagctgcttttactcagtttgggaatgatggttgtctccgttatctctgttctctccttcagaaattcgaggctgcagttccttcagtttatccatttgatcaatatgcacgccttagtataattgtcactcttgaaagcttaggaattgatagagatttcaaaaccgaaatcaaaagcatattggatgaaacctatagatattggcttcgtggggatgaagaaatatgtttggacttggccacttgtgctttggctttccgattattgcttgctcatggctatgatgtgtcttacgatccgctaaaaccatttgcagaagaatctggtttctctgatactttggaaggatatgttaagaatacgttttctgtgttagaattatttaaggctgctcaaagttatccacatgaatcagctttgaagaagcagtgttgttggactaaacaatatctggagatggaattgtccagctgggttaagacctctgttcgagataaatacctcaagaaagaggtcgaggatgctcttgcttttccctcctatgcaagcctagaaagatcagatcacaggagaaaaatactcaatggttctgctgtggaaaacaccagagttacaaaaacctcatatcgtttgcacaatatttgcacctctgatatcctgaagttagctgtggatgacttcaatttctgccagtccatacaccgtgaagaaatggaacgtcttgataggtggattgtggagaatagattgcaggaactgaaatttgccagacagaagctggcttactgttatttctctggggctgcaactttattttctccagaactatctgatgctcgtatatcgtgggccaaaggtggagtacttacaacggttgtagacgacttctttgatgttggagggtccaaagaagaactggaaaacctcatacacttggtcgaaaagtgggatttgaacggtgttcctgagtacagctcagaacatgttgagatcatattctcagttctaagggacaccattctcgaaacaggagacaaagcattcacctatcaaggacgcaatgtgacacaccacattgtgaaaatttggttggatctgctcaagtctatgttgagagaagccgagtggtccagtgacaagtcaacaccaagcttggaggattacatggaaaatgcgtacatatcatttgcattaggaccaattgtcctcccagctacctatctgatcggacctccacttccagagaagacagtcgatagccaccaatataatcagctctacaagctcgtgagcactatgggtcgtcttctaaatgacatacaaggttttaagagagaaagcgcggaagggaagctgaatgcggtttcattgcacatgaaacacgagagagacaatcgcagcaaagaagtgatcatagaatcgatgaaaggtttagcagagagaaagagggaagaattgcataagctagttttggaggagaaaggaagtgtggttccaagggaatgcaaagaagcgttcttgaaaatgagcaaagtgttgaacttattttacaggaaggacgatggattcacatcaaatgatctgatgagtcttgttaaatcagtgatctacgagcctgttagcttacagaaagaatctttaacttga

SEQ ID NO: 52 - protein, 785 aa, Arabidopsis thaliana
MSINLRSSGCSSPISATLERGLDSEVQTRANNVSFEQTKEKIRKMLEKVELSVSAYDTSWVAMVPSPSSQNAPLFPQCVKWLLDNQHEDGSWGLDNHDHQSLKKDVLSSTLASILALKKWGIGERQINKGLQFIELNSALVTDETIQKPTGFDIIFPGMIKYARDLNLTIPLGSEVVDDMIRKRDLDLKCDSEKFSKGREAYLAYVLEGTRNLKDWDLIVKYQRKNGSLFDSPATTAAAFTQFGNDGCLRYLCSLLQKFEAAVPSVYPFDQYARLSIIVTLESLGIDRDFKTEIKSILDETYRYWLRGDEEICLDLATCALAFRLLLAHGYDVSYDPLKPFAEESGFSDTLEGYVKNTFSVLELFKAAQSYPHESALKKQCCWTKQYLEMELSSWVKTSVRDKYLKKEVEDALAFPSYASLERSDHRRKILNGSAVENTRVTKTSYRLHNICTSDILKLAVDDFNFCQSIHREEMERLDRWIVENRLQELKFARQKLAYCYFSGAATLFSPELSDARISWAKGGVLTTVVDDFFDVGGSKEELENLIHLVEKWDLNGVPEYSSEHVEIIFSVLRDTILETGDKAFTYQGRNVTHHIVKIWLDLLKSMLREAEWSSDKSTPSLEDYMENAYISFALGPIVLPATYLIGPPLPEKTVDSHQYNQLYKLVSTMGRLLNDIQGFKRESAEGKLNAVSLHMKHERDNRSKEVIIESMKGLAERKREELHKLVLEEKGSVVPRECKEAFLKMSKVLNLFYRKDDGFTSNDLMSLVKSVIYEPVSLQKESLT

SEQ ID NO: 53 - DNA, 2952 bp, Artificial Sequence
  Codon-optimized CDPS-KS
atggaatttgatgaaccattggttgacgaagcaagatctttagtgcagcgtactttacaagattatgatgacagatacggcttcggtactatgtcatgtgctgcttatgatacagcctgggtgtctttagttacaaaaacagtcgatgggagaaaacaatggcttttcccagagtgttttgaatttctactagaaacacaatctgatgccggaggatgggaaatcgggaattcagcaccaatcgacggtatattgaatacagctgcatccttacttgctctaaaacgtcacgttcaaactgagcaaatcatccaacctcaacatgaccataaggatctagcaggtagagctgaacgtgccgctgcatctttgagagcacaattggctgcattggatgtgtctacaactgaacacgtcggttttgagataattgttcctgcaatgctagacccattagaagccgaagatccatctctagttttcgattttccagctaggaaacctttgatgaagattcatgatgctaagatgagtagattcaggccagaatacttgtatggcaaacaaccaatgaccgccttacattcattagaggctttcataggcaaaatcgacttcgataaggtaagacaccaccgtacccatgggtctatgatgggttctccttcatctaccgcagcctacttaatgcacgcttcacaatgggatggtgactcagaggcttaccttagacacgtgattaaacacgcagcagggcagggaactggtgctgtaccatctgctttcccatcaacacattttgagtcatcttggattcttaccacattgtttagagctggattttcagcttctcatcttgcctgtgatgagttgaacaagttggtcgagatacttgagggctcattcgagaaggaaggtggggcaatcggttacgctccagggtttcaagcagatgttgatgatactgctaaaacaataagtacattagcagtccttggaagagatgctacaccaagacaaatgatcaaggtatttgaagctaatacacattttagaacataccctggtgaaagagatccttctttgacagctaattgtaatgctctatcagccttactacaccaaccagatgcagcaatgtatggatctcaaattcaaaagattaccaaatttgtctgtgactattggtggaagtctgatggtaagattaaagataagtggaacacttgctacttgtacccatctgtcttattagttgaggttttggttgatcttgttagtttattggagcagggtaaattgcctgatgttttggatcaagagcttcaatacagagtcgccatcacattgttccaagcatgtttaaggccattactagaccaagatgccgaaggatcatggaacaagtctatcgaagccacagcctacggcatccttatcctaactgaagctaggagagtttgtttcttcgacagattgtctgagccattgaatgaggcaatccgtagaggtatcgctttcgccgactctatgtctggaactgaagctcagttgaactacatttggatcgaaaaggttagttacgcacctgcattattgactaaatcctatttgttagcagcaagatgggctgctaagtctcctttaggcgcttccgtaggctcttctttgtggactccaccaagagaaggattggataagcatgtcagattattccatcaagctgagttattcagatcccttccagaatgggaattaagagcctccatgattgaagcagctttgttcacaccacttctaagagcacatagactagacgttttccctagacaagatgtaggtgaagacaaatatcttgatgtagttccattcttttggactgccgctaacaacagagatagaacttacgcttccactctattcctttacgatatgtgttttatcgcaatgttaaacttccagttagacgaattcatggaggccacagccggtatcttattcagagatcatatggatgatttgaggcaattgattcatgatcttttggcagagaaaacttccccaaagagttctggtagaagtagtcagggcacaaaagatgctgactcaggtatagaggaagacgtgtcaatgtccgattcagcttcagattcccaggatagaagtccagaatacgacttggttttcagtgcattgagtacctttacaaaacatgtcttgcaacacccatctatacaaagtgcctctgtatgggatagaaaactacttgctagagagatgaaggcttacttacttgctcatatccaacaagcagaagattcaactccattgtctgaattgaaagatgtgcctcaaaagactgatgtaacaagagtttctacatctactactaccttctttaactgggttagaacaacttccgcagaccatatatcctgcccatactccttccactttgtagcatgccatctaggcgcagcattgtcacctaaagggtctaacggtgattgctatccttcagctggtgagaagttcttggcagctgcagtctgcagacatttggccaccatgtgtagaatgtacaacgatcttggatcagctgaacgtgattctgatgaaggtaatttgaactccttggacttccctgaattcgccgattccgcaggaaacggagggatagaaattcagaaggccgctctattaaggttagctgagtttgagagagattcatacttagaggccttccgtcgtttacaagatgaatccaatagagttcacggtccagccggtggtgatgaagccagattgtccagaaggagaatggcaatccttgaattcttcgcccagcaggtagatttgtacggtcaagtatacgtcattagggatatttccgctcgtattcctaaaaacgaggttgagaaaaagagaaaattggatgatgctttcaattga

SEQ ID NO: 54 - protein, 983 aa, Phomopsis amygdali
MEFDEPLVDEARSLVQRTLQDYDDRYGFGTMSCAAYDTAWVSLVTKTVDGRKQWLFPECFEFLLETQSDAGGWEIGNSAPIDGILNTAASLLALKRHVQTEQIIQPQHDHKDLAGRAERAAASLRAQLAALDVSTTEHVGFEIIVPAMLDPLEAEDPSLVFDFPARKPLMKIHDAKMSRFRPEYLYGKQPMTALHSLEAFIGKIDFDKVRHHRTHGSMMGSPSSTAAYLMHASQWDGDSEAYLRHVIKHAAGQGTGAVPSAFPSTHFESSWILTTLFRAGFSASHLACDELNKLVEILEGSFEKEGGAIGYAPGFQADVDDTAKTISTLAVLGRDATPRQMIKVFEANTHFRTYPGERDPSLTANCNALSALLHQPDAAMYGSQIQKITKFVCDYWWKSDGKIKDKWNTCYLYPSVLLVEVLVDLVSLLEQGKLPDVLDQELQYRVAITLFQACLRPLLDQDAEGSWNKSIEATAYGILILTEARRVCFFDRLSEPLNEAIRRGIAFADSMSGTEAQLNYIWIEKVSYAPALLTKSYLLAARWAAKSPLGASVGSSLWTPPREGLDKHVRLFHQAELFRSLPEWELRASMIEAALFTPLLRAHRLDVFPRQDVGEDKYLDVVPFFWTAANNRDRTYASTLFLYDMCFIAMLNFQLDEFMEATAGILFRDHMDDLRQLIHDLLAEKTSPKSSGRSSQGTKDADSGIEEDVSMSDSASDSQDRSPEYDLVFSALSTFTKHVLQHPSIQSASVWDRKLLAREMKAYLLAHIQQAEDSTPLSELKDVPQKTDVTRVSTSTTTFFNWVRTTSADHISCPYSFHFVACHLGAALSPKGSNGDCYPSAGEKFLAAAVCRHLATMCRMYNDLGSAERDSDEGNLNSLDFPEFADSAGNGGIEIQKAALLRLAEFERDSYLEAFRRLQDESNRVHGPAGGDEARLSRRRMAILEFFAQQVDLYGQVYVIRDISARIPKNEVEKKRKLDDAFN

SEQ ID NO: 55 - DNA, 2646 bp, Artificial Sequence
  Codon-optimized CDPS-KS
atggcttctagtacacttatccaaaacagatcatgtggcgtcacatcatctatgtcaagttttcaaatcttcagaggtcaaccactaagatttcctggcactagaaccccagctgcagttcaatgcttgaaaaagaggagatgccttaggccaaccgaatccgtactagaatcatctcctggctctggttcatatagaatagtaactggcccttctggaattaaccctagttctaacgggcacttgcaagagggttccttgactcacaggttaccaataccaatggaaaaatctatcgataacttccaatctactctatatgtgtcagatatttggtctgaaacactacagagaactgaatgtttgctacaagtaactgaaaacgtccagatgaatgagtggattgaggaaattagaatgtactttagaaatatgactttaggtgaaatttccatgtccccttacgacactgcttgggtggctagagttccagcgttggacggttctcatgggcctcaattccacagatctttgcaatggattatcgacaaccaattaccagatggggactggggcgaaccttctcttttcttgggttacgatagagtttgtaatactttagcctgtgtgattgcgttgaaaacatggggtgttggggcacaaaacgttgaaagaggaattcagttcctacaatctaacatatacaagatggaggaagatgacgctaatcatatgccaataggattcgaaatcgtattccctgctatgatggaagatgccaaagcattaggtttggatttgccatacgatgctactattttgcaacagatttcagccgaaagagagaaaaagatgaaaaagatcccaatggcaatggtgtacaaatacccaaccactttacttcactccttagaaggcttgcatagagaagttgattggaataagttgttacaattacaatctgaaaatggtagttttctttattcacctgcttcaaccgcatgcgccttaatgtacactaaggacgttaaatgttttgattacttaaaccagttgttgatcaagttcgaccacgcatgcccaaatgtatatccagtcgatctattcgaaagattatggatggttgacagattgcagagattagggatctccagatactttgaaagagagattagagattgtttacaatacgtctacagatattggaaagattgtggaatcggatgggcttctaactcttccgtacaagatgttgatgatacagccatggcgtttagacttttaaggactcatggtttcgacgtaaaggaagattgctttagacagtttttcaaggacggagaattcttctgcttcgcaggccaatcatctcaagcagttacaggcatgtttaatctttcaagagccagtcaaacattgtttccaggagaatctttattgaaaaaggctagaaccttctctagaaacttcttgagaacaaagcatgagaacaacgaatgtttcgataaatggatcattactaaagatttggctggtgaagtcgagtataacttgaccttcccatggtatgcctctttgcctagattagaacataggacatacttagatcaatatggaatcgatgatatctggataggcaaatctttatacaaaatgcctgctgttaccaacgaagttttcctaaagttggcaaaggcagactttaacatgtgtcaagctctacacaaaaaggaattggaacaagtgataaagtggaacgcgtcctgtcaattcagagatcttgaattcgccagacaaaaatcagtagaatgctattttgctggtgcagccacaatgttcgaaccagaaatggttcaagctagattagtctgggcaagatgttgtgtattgacaactgtcttagacgattactttgaccacgggacacctgttgaggaacttagagtgtttgttcaagctgtcagaacatggaatccagagttgatcaacggtttgccagagcaagctaaaatcttgtttatgggcttatacaaaacagttaacacaattgcagaggaagcattcatggcacagaaaagagacgtccatcatcatttgaaacactattgggacaagttgataacaagtgccctaaaggaggccgaatgggcagagtcaggttacgtcccaacatttgatgaatacatggaagtagctgaaatttctgttgctctagaaccaattgtctgtagtaccttgttctttgcgggtcatagactagatgaggatgttctagatagttacgattaccatctagttatgcatttggtaaacagagtcggtagaatcttgaatgatatacaaggcatgaagagggaggcttcacaaggtaagatctcatcagttcaaatctacatggaggaacatccatctgttccatctgaggccatggcgatcgctcatcttcaagagttagttgataattcaatgcagcaattgacatacgaagttcttaggttcactgcggttccaaaaagttgtaagagaatccacttgaatatggctaaaatcatgcatgccttctacaaggatactgatggattctcatcccttactgcaatgacaggattcgtcaaaaaggttcttttcgaacctgtgcctgagtaa

SEQ ID NO: 56 - protein, 881 aa, Physcomitrella patens
MASSTLIQNRSCGVTSSMSSFQIFRGQPLRFPGTRTPAAVQCLKKRRCLRPTESVLESSPGSGSYRIVTGPSGINPSSNGHLQEGSLTHRLPIPMEKSIDNFQSTLYVSDIWSETLQRTECLLQVTENVQMNEWIEEIRMYFRNMTLGEISMSPYDTAWVARVPALDGSHGPQFHRSLQWIIDNQLPDGDWGEPSLFLGYDRVCNTLACVIALKTWGVGAQNVERGIQFLQSNIYKMEEDDANHMPIGFEIVFPAMMEDAKALGLDLPYDATILQQISAEREKKMKKIPMAMVYKYPTTLLHSLEGLHREVDWNKLLQLQSENGSFLYSPASTACALMYTKDVKCFDYLNQLLIKFDHACPNVYPVDLFERLWMVDRLQRLGISRYFEREIRDCLQYVYRYWKDCGIGWASNSSVQDVDDTAMAFRLLRTHGFDVKEDCFRQFFKDGEFFCFAGQSSQAVTGMFNLSRASQTLFPGESLLKKARTFSRNFLRTKHENNECFDKWIITKDLAGEVEYNLTFPWYASLPRLEHRTYLDQYGIDDIWIGKSLYKMPAVTNEVFLKLAKADFNMCQALHKKELEQVIKWNASCQFRDLEFARQKSVECYFAGAATMFEPEMVQARLVWARCCVLTTVLDDYFDHGTPVEELRVFVQAVRTWNPELINGLPEQAKILFMGLYKTVNTIAEEAFMAQKRDVHHHLKHYWDKLITSALKEAEWAESGYVPTFDEYMEVAEISVALEPIVCSTLFFAGHRLDEDVLDSYDYHLVMHLVNRVGRILNDIQGMKREASQGKISSVQIYMEEHPSVPSEAMAIAHLQELVDNSMQQLTYEVLRFTAVPKSCKRIHLNMAKIMHAFYKDTDGFSSLTAMTGFVKKVLFEPVPE

SEQ ID NO: 57 - DNA, 2859 bp, Artificial Sequence
  Codon-optimized CDPS-KS
atgcctggtaaaattgaaaatggtaccccaaaggacctcaagactggaaatgattttgtttctgctgctaagagtttactagatcgagctttcaaaagtcatcattcctactacggattatgctcaacttcatgtcaagtttatgatacagcttgggttgcaatgattccaaaaacaagagataatgtaaaacagtggttgtttccagaatgtttccattacctcttaaaaacacaagccgcagatggctcatggggttcattgcctacaacacagacagcgggtatcctagatacagcctcagctgtgctggcattattgtgccacgcacaagagcctttacaaatattggatgtatctccagatgaaatggggttgagaatagaacacggtgtcacatccttgaaacgtcaattagcagtttggaatgatgtggaggacaccaaccatattggcgtcgagtttatcataccagccttactttccatgctagaaaaggaattagatgttccatcttttgaatttccatgtaggtccatcttagagagaatgcacggggagaaattaggtcatttcgacctggaacaagtttacggcaagccaagctcattgttgcactcattggaagcatttctcggtaagctagattttgatcgactatcacatcacctataccacggcagtatgatggcatctccatcttcaacggctgcttatcttattggggctacaaaatgggatgacgaagccgaagattacctaagacatgtaatgcgtaatggtgcaggacatgggaatggaggtatttctggtacatttccaactactcatttcgaatgtagctggattatagcaacgttgttaaaggttggctttactttgaagcaaattgacggcgatggcttaagaggtttatcaaccatcttacttgaggcgcttcgtgatgagaatggtgtcataggctttgcccctagaacagcagatgtagatgacacagccaaagctctattggccttgtcattggtaaaccagccagtgtcacctgatatcatgattaaggtctttgagggcaaagaccattttaccacttttggttcagaaagagatccatcattgacttccaacctgcacgtccttttatctttacttaaacaatctaacttgtctcaataccatcctcaaatcctcaaaacaacattattcacttgtagatggtggtggggttccgatcattgtgtcaaagacaaatggaatttgagtcacctatatccaactatgttgttggttgaagccttcactgaagtgctccatctcattgacggtggtgaattgtctagtctgtttgatgaatcctttaagtgtaagattggtcttagcatctttcaagcggtacttagaataatcctcacccaagacaacgacggctcttggagaggatacagagaacagacgtgttacgcaatattggctttagttcaagcgagacatgtatgctttttcactcacatggttgacagactgcaatcatgtgttgatcgaggtttctcatggttgaaatcttgctcttttcattctcaagacctgacttggacctctaaaacagcttatgaagtgggtttcgtagctgaagcatataaactagctgctttacaatctgcttccctggaggttcctgctgccaccattggacattctgtcacgtctgccgttccatcaagtgatcttgaaaaatacatgagattggtgagaaaaactgcgttattctctccactggatgagtggggtctaatggcttctatcatcgaatcttcatttttcgtaccattactgcaggcacaaagagttgaaatataccctagagataatatcaaggtggacgaagataagtacttgtctattatcccattcacatgggtcggatgcaataataggtctagaactttcgcaagtaacagatggctatacgatatgatgtacctttcattactcggctatcaaaccgacgagtacatggaagctgtagctgggccagtgtttggggatgtttccttgttacatcaaacaattgataaggtgattgataatacaatgggtaaccttgcgagagccaatggaacagtacacagtggtaatggacatcagcacgaatctcctaatataggtcaagtcgaggacaccttgactcgtttcacaaattcagtcttgaatcacaaagacgtccttaactctagctcatctgatcaagatactttgagaagagagtttagaacattcatgcacgctcatataacacaaatcgaagataactcacgattcagtaagcaagcctcatccgatgcgttttcctctcctgaacaatcttactttcaatgggtgaactcaactggtggctcacatgtcgcttgcgcctattcatttgccttctctaattgcctcatgtctgcaaatttgttgcagggtaaagacgcatttccaagcggaacgcaaaagtacttaatctcctctgttatgagacatgccacaaacatgtgtagaatgtataacgactttggctctattgccagagacaacgctgagagaaatgttaatagtattcattttcctgagtttactctctgtaacggaacttctcaaaacctagatgaaaggaaggaaagacttctgaaaatcgcaacttacgaacaagggtatttggatagagcactagaggccttggaaagacagagtagagatgatgccggagacagagctggatctaaagatatgagaaagttgaaaatcgttaagttattctgtgatgttacggacttatacgatcagctctacgttatcaaagatttgtcatcctctatgaagtaa

SEQ ID NO: 58 - protein, 952 aa, Gibberella fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 59 - DNA, 1542 bp, Artificial Sequence
  Codon-optimized KO
atggatgctgtgacgggtttgttaactgtcccagcaaccgctataactattggtggaactgctgtagcattggcggtagcgctaatcttttggtacctgaaatcctacacatcagctagaagatcccaatcaaatcatcttccaagagtgcctgaagtcccaggtgttccattgttaggaaatctgttacaattgaaggagaaaaagccatacatgacttttacgagatgggcagcgacatatggacctatctatagtatcaaaactggggctacaagtatggttgtggtatcatctaatgagatagccaaggaggcattggtgaccagattccaatccatatctacaaggaacttatctaaagccctgaaagtacttacagcagataagacaatggtcgcaatgtcagattatgatgattatcataaaacagttaagagacacatactgaccgccgtcttgggtcctaatgcacagaaaaagcatagaattcacagagatatcatgatggataacatatctactcaacttcatgaattcgtgaaaaacaacccagaacaggaagaggtagaccttagaaaaatctttcaatctgagttattcggcttagctatgagacaagccttaggaaaggatgttgaaagtttgtacgttgaagacctgaaaatcactatgaatagagacgaaatctttcaagtccttgttgttgatccaatgatgggagcaatcgatgttgattggagagacttctttccatacctaaagtgggtcccaaacaaaaagttcgaaaatactattcaacaaatgtacatcagaagagaagctgttatgaaatctttaatcaaagagcacaaaaagagaatagcgtcaggcgaaaagctaaatagttatatcgattaccttttatctgaagctcaaactttaaccgatcagcaactattgatgtccttgtgggaaccaatcattgaatcttcagatacaacaatggtcacaacagaatgggcaatgtacgaattagctaaaaaccctaaattgcaagataggttgtacagagacattaagtccgtctgtggatctgaaaagataaccgaagagcatctatcacagctgccttacattacagctattttccacgaaacactgagaagacactcaccagttcctatcattcctctaagacatgtacatgaagataccgttctaggcggctaccatgttcctgctggcacagaacttgccgttaacatctacggttgcaacatggacaaaaacgtttgggaaaatccagaggaatggaacccagaaagattcatgaaagagaatgagacaattgattttcaaaagacgatggccttcggtggtggtaagagagtttgtgctggttccttgcaagcccttttaactgcatctattgggattgggagaatggttcaagagttcgaatggaaactgaaggatatgactcaagaggaagtgaacacgataggcctaactacacaaatgttaagaccattgagagctattatcaaacctaggatctaa

SEQ ID NO: 60 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKEHKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 61 - DNA, 1566 bp, Artificial Sequence
  Codon-optimized KO
aagcttactagtaaaatggacggtgtcatcgatatgcaaaccattccattgagaaccgctattgctattggtggtactgctgttgctttggttgttgcattatacttttggttcttgagatcctacgcttccccatctcatcattctaatcatttgccaccagtacctgaagttccaggtgttccagttttgggtaatttgttgcaattgaaagaaaaaaagccttacatgaccttcaccaagtgggctgaaatgtatggtccaatctactctattagaactggtgctacttccatggttgttgtctcttctaacgaaatcgccaaagaagttgttgttaccagattcccatctatctctaccagaaaattgtcttacgccttgaaggttttgaccgaagataagtctatggttgccatgtctgattatcacgattaccataagaccgtcaagagacatattttgactgctgttttgggtccaaacgcccaaaaaaagtttagagcacatagagacaccatgatggaaaacgtttccaatgaattgcatgccttcttcgaaaagaacccaaatcaagaagtcaacttgagaaagatcttccaatcccaattattcggtttggctatgaagcaagccttgggtaaagatgttgaatccatctacgttaaggatttggaaaccaccatgaagagagaagaaatcttcgaagttttggttgtcgatccaatgatgggtgctattgaagttgattggagagactttttcccatacttgaaatgggttccaaacaagtccttcgaaaacatcatccatagaatgtacactagaagagaagctgttatgaaggccttgatccaagaacacaagaaaagaattgcctccggtgaaaacttgaactcctacattgattacttgttgtctgaagcccaaaccttgaccgataagcaattattgatgtctttgtgggaacctattatcgaatcttctgataccactatggttactactgaatgggctatgtacgaattggctaagaatccaaacatgcaagacagattatacgaagaaatccaatccgtttgcggttccgaaaagattactgaagaaaacttgtcccaattgccatacttgtacgctgttttccaagaaactttgagaaagcactgtccagttcctattatgccattgagatatgttcacgaaaacaccgttttgggtggttatcatgttccagctggtactgaagttgctattaacatctacggttgcaacatggataagaaggtctgggaaaatccagaagaatggaatccagaaagattcttgtccgaaaaagaatccatggacttgtacaaaactatggcttttggtggtggtaaaagagtttgcgctggttctttacaagccatggttatttcttgcattggtatcggtagattggtccaagattttgaatggaagttgaaggatgatgccgaagaagatgttaacactttgggtttgactacccaaaagttgcatccattattggccttgattaacccaagaaagtaactcgagccgcgg

SEQ ID NO: 62 - protein, 512 aa, Lactuca sativa
MDGVIDMQTIPLRTAIAIGGTAVALVVALYFWFLRSYASPSHHSNHLPPVPEVPGVPVLGNLLQLKEKKPYMTFTKWAEMYGPIYSIRTGATSMVVVSSNEIAKEVVVTRFPSISTRKLSYALKVLTEDKSMVAMSDYHDYHKTVKRHILTAVLGPNAQKKFRAHRDTMMENVSNELHAFFEKNPNQEVNLRKIFQSQLFGLAMKQALGKDVESIYVKDLETTMKREEIFEVLVVDPMMGAIEVDWRDFFPYLKWVPNKSFENIIHRMYTRREAVMKALIQEHKKRIASGENLNSYIDYLLSEAQTLTDKQLLMSLWEPIIESSDTTMVTTEWAMYELAKNPNMQDRLYEEIQSVCGSEKITEENLSQLPYLYAVFQETLRKHCPVPIMPLRYVHENTVLGGYHVPAGTEVAINIYGCNMDKKVWENPEEWNPERFLSEKESMDLYKTMAFGGGKRVCAGSLQAMVISCIGIGRLVQDFEWKLKDDAEEDVNTLGLTTQKLHPLLALINPRK

SEQ ID NO: 63 - DNA, 1535 bp, Rubus suavissimus
atggccaccctccttgagcatttccaagctatgccctttgccatccctattgcactggctgctctgtcttggctgttcctcttttacatcaaagtttcattcttttccaacaagagtgctcaggctaagctccctcctgtgccagtggttcctgggctgccggtgattgggaatttactgcaactcaaggagaagaaaccctaccagacttttacaaggtgggctgaggagtatggaccaatctattctatcaggactggtgcttccaccatggtcgttctcaataccacccaagttgcaaaagaggccatggtgaccagatatttatccatctcaaccagaaagctatcaaacgcactaaagattcttactgctgataaatgtatggttgcaataagtgactacaacgattttcacaagatgataaagcgatacatactctcaaatgttcttggacctagtgctcagaagcgtcaccggagcaacagagataccttgagagctaatgtctgcagccgattgcattctcaagtaaagaactctcctcgagaagctgtgaatttcagaagagtttttgagtgggaactctttggaattgcattgaagcaagcctttggaaaggacatagaaaagcccatttatgtggaggaacttggcactacactgtcaagagatgagatctttaaggttctagtgcttgacataatggagggtgcaattgaggttgattggagagatttcttcccttacctgagatggattccgaatacgcgcatggaaacaaaaattcagcgactctatttccgcaggaaagcagtgatgactgccctgatcaacgagcagaagaagcgaattgcttcaggagaggaaatcaactgttatatcgacttcttgcttaaggaagggaagacactgacaatggaccaaataagtatgttgctttgggagacggttattgaaacagcagatactacaatggtaacgacagaatgggctatgtatgaagttgctaaagactcaaagcgtcaggatcgtctctatcaggaaatccaaaaggtttgtggatcggagatggttacagaggaatacttgtcccaactgccgtacctgaatgcagttttccatgaaacgctaaggaagcacagtccggctgcgttagttcctttaagatatgcacatgaagatacccaactaggaggttactacattccagctggaactgagattgctataaacatatacgggtgtaacatggacaagcatcaatgggaaagccctgaggaatggaaaccggagagatttttggacccgaaatttgatcctatggatttgtacaagaccatggcttttggggctggaaagagggtatgtgctggttctcttcaggcaatgttaatagcgtgcccgacgattggtaggctggtgcaggagtttgagtggaagctgagagatggagaagaagaaaatgtagatactgttgggctcaccactcacaaacgctatccaatgcatgcaatcctgaagccaagaagtta

SEQ ID NO: 64 - DNA, 1536 bp, Artificial Sequence
  Codon-optimized KO
atggctaccttgttggaacattttcaagctatgccattcgctattccaattgctttggctgctttgtcttggttgtttttgttctacatcaaggtttctttcttctccaacaaatccgctcaagctaaattgccaccagttccagttgttccaggtttgccagttattggtaatttgttgcaattgaaagaaaagaagccataccaaaccttcactagatgggctgaagaatatggtccaatctactctattagaactggtgcttctactatggttgtcttgaacactactcaagttgccaaagaagctatggttaccagatacttgtctatctctaccagaaagttgtccaacgccttgaaaattttgaccgctgataagtgcatggttgccatttctgattacaacgatttccacaagatgatcaagagatatatcttgtctaacgttttgggtccatctgcccaaaaaagacatagatctaacagagataccttgagagccaacgtttgttctagattgcattcccaagttaagaactctccaagagaagctgtcaactttagaagagttttcgaatgggaattattcggtatcgctttgaaacaagccttcggtaaggatattgaaaagccaatctacgtcgaagaattgggtactactttgtccagagatgaaatcttcaaggttttggtcttggacattatggaaggtgccattgaagttgattggagagattttttcccatacttgcgttggattccaaacaccagaatggaaactaagatccaaagattatactttagaagaaaggccgttatgaccgccttgattaacgaacaaaagaaaagaattgcctccggtgaagaaatcaactgctacatcgatttcttgttgaaagaaggtaagaccttgaccatggaccaaatctctatgttgttgtgggaaaccgttattgaaactgctgataccacaatggttactactgaatgggctatgtacgaagttgctaaggattctaaaagacaagacagattataccaagaaatccaaaaggtctgcggttctgaaatggttacagaagaatacttgtcccaattgccatacttgaatgctgttttccacgaaactttgagaaaacattctccagctgctttggttccattgagatatgctcatgaagatactcaattgggtggttattacattccagccggtactgaaattgccattaacatctacggttgcaacatggacaaacaccaatgggaatctccagaagaatggaagccagaaagatttttggatcctaagtttgacccaatggacttgtacaaaactatggcttttggtgctggtaaaagagtttgcgctggttctttacaagctatgttgattgcttgtccaaccatcggtagattggttcaagaatttgaatggaagttgagagatggtgaagaagaaaacgttgatactgttggtttgaccacccataagagatatccaatgcatgctattttgaagccaagatcttaa

SEQ ID NO: 65 - DNA, 1572 bp, Artificial Sequence
  Codon-optimized KO
aagcttactagtaaaatggcctccatcacccatttcttacaagattttcaagctactccattcgctactgcttttgctgttggtggtgtttctttgttgatattcttcttcttcatccgtggtttccactctactaagaaaaacgaatattacaagttgccaccagttccagttgttccaggtttgccagttgttggtaatttgttgcaattgaaagaaaagaagccatacaagactttcttgagatgggctgaaattcatggtccaatctactctattagaactggtgcttctaccatggttgttgttaactctactcatgttgccaaagaagctatggttaccagattctcttcaatctctaccagaaagttgtccaaggctttggaattattgacctccaacaaatctatggttgccacctctgattacaacgaatttcacaagatggtcaagaagtacatcttggccgaattattgggtgctaatgctcaaaagagacacagaattcatagagacaccttgatcgaaaacgtcttgaacaaattgcatgcccataccaagaattctccattgcaagctgttaacttcagaaagatcttcgaatctgaattattcggtttggctatgaagcaagccttgggttatgatgttgattccttgttcgttgaagaattgggtactaccttgtccagagaagaaatctacaacgttttggtcagtgacatgttgaagggtgctattgaagttgattggagagactttttcccatacttgaaatggatcccaaacaagtccttcgaaatgaagattcaaagattggcctctagaagacaagccgttatgaactctattgtcaaagaacaaaagaagtccattgcctctggtaagggtgaaaactgttacttgaattacttgttgtccgaagctaagactttgaccgaaaagcaaatttccattttggcctgggaaaccattattgaaactgctgatacaactgttgttaccactgaatgggctatgtacgaattggctaaaaacccaaagcaacaagacagattatacaacgaaatccaaaacgtctgcggtactgataagattaccgaagaacatttgtccaagttgccttacttgtctgctgtttttcacgaaaccttgagaaagtattctccatctccattggttccattgagatacgctcatgaagatactcaattgggtggttattatgttccagccggtactgaaattgctgttaatatctacggttgcaacatggacaagaatcaatgggaaactccagaagaatggaagccagaaagatttttggacgaaaagtacgatccaatggacatgtacaagactatgtcttttggttccggtaaaagagtttgcgctggttctttacaagctagtttgattgcttgtacctccatcggtagattggttcaagaatttgaatggagattgaaagacggtgaagttgaaaacgttgataccttgggtttgactacccataagttgtatccaatgcaagctatcttgcaacctagaaactgactcgagccgcgg

SEQ ID NO: 66 - protein, 514 aa, Castanea mollissima
MASITHFLQDFQATPFATAFAVGGVSLLIFFFFIRGFHSTKKNEYYKLPPVPVVPGLPVVGNLLQLKEKKPYKTFLRWAEIHGPIYSIRTGASTMVVVNSTHVAKEAMVTRFSSISTRKLSKALELLTSNKSMVATSDYNEFHKMVKKYILAELLGANAQKRHRIHRDTLIENVLNKLHAHTKNSPLQAVNFRKIFESELFGLAMKQALGYDVDSLFVEELGTTLSREEIYNVLVSDMLKGAIEVDWRDFFPYLKWIPNKSFEMKIQRLASRRQAVMNSIVKEQKKSIASGKGENCYLNYLLSEAKTLTEKQISILAWETIIETADTTVVTTEWAMYELAKNPKQQDRLYNEIQNVCGTDKITEEHLSKLPYLSAVFHETLRKYSPSPLVPLRYAHEDTQLGGYYVPAGTEIAVNIYGCNMDKNQWETPEEWKPERFLDEKYDPMDMYKTMSFGSGKRVCAGSLQASLIACTSIGRLVQEFEWRLKDGEVENVDTLGLTTHKLYPMQAILQPRN

SEQ ID NO: 67 - DNA, 1512 bp, Artificial Sequence
  Codon-optimized KO
atgatttccttgttgttgggttttgttgtctcctccttcttgtttatcttcttcttgaaaaaattgttgttcttcttcagtcgtcacaaaatgtccgaagtttctagattgccatctgttccagttccaggttttccattgattggtaacttgttgcaattgaaagaaaagaagccacacaagactttcaccaagtggtctgaattatatggtccaatctactctatcaagatgggttcctcttctttgatcgtcttgaactctattgaaaccgccaaagaagctatggtcagtagattctcttcaatctctaccagaaagttgtctaacgctttgactgttttgacctgcaacaaatctatggttgctacctctgattacgatgactttcataagttcgtcaagagatgcttgttgaacggtttgttgggtgctaatgctcaagaaagaaaaagacattacagagatgccttgatcgaaaacgttacctctaaattgcatgcccataccagaaatcatccacaagaaccagttaacttcagagccattttcgaacacgaattattcggtgttgctttgaaacaagccttcggtaaagatgtcgaatccatctatgtaaaagaattgggtgtcaccttgtccagagatgaaattttcaaggttttggtccacgacatgatggaaggtgctattgatgttgattggagagatttcttcccatacttgaaatggatcccaaacaactctttcgaagccagaattcaacaaaagcacaagagaagattggctgttatgaacgccttgatccaagacagattgaatcaaaacgattccgaatccgatgatgactgctacttgaatttcttgatgtctgaagctaagaccttgaccatggaacaaattgctattttggtttgggaaaccattatcgaaactgctgataccactttggttactactgaatgggctatgtacgaattggccaaacatcaatctgttcaagatagattattcaaagaaatccaatccgtctgcggtggtgaaaagatcaaagaagaacaattgccaagattgccttacgtcaatggtgtttttcacgaaaccttgagaaagtattctccagctccattggttccaattagatacgctcatgaagatacccaaattggtggttatcatattccagccggttctgaaattgccattaacatctacggttgcaacatggataagaagagatgggaaagacctgaagaatggtggccagaaagatttttggaagatagatacgaatcctccgacttgcataagactatggcttttggtgctggtaaaagagtttgtgctggtgctttacaagctagtttgatggctggtattgctatcggtagattggttcaagaattcgaatggaagttgagagatggtgaagaagaaaacgttgatacttacggtttgacctcccaaaagttgtatccattgatggccattatcaacccaagaagatcttaa

SEQ ID NO: 68 - protein, 506 aa, Thellungiella halophila
MASMISLLLGFVVSSFLFIFFLKKLLFFFSRHKMSEVSRLPSVPVPGFPLIGNLLQLKEKKPHKTFTKWSELYGPIYSIKMGSSSLIVLNSIETAKEAMVSRFSSISTRKLSNALTVLTCNKSMVATSDYDDFHKFVKRCLLNGLLGANAQERKRHYRDALIENVTSKLHAHTRNHPQEPVNFRAIFEHELFGVALKQAFGKDVESIYVKELGVTLSRDEIFKVLVHDMMEGAIDVDWRDFFPYLKWIPNNSFEARIQQKHKRRLAVMNALIQDRLNQNDSESDDDCYLNFLMSEAKTLTMEQIAILVWETIIETADTTLVTTEWAMYELAKHQSVQDRLFKEIQSVCGGEKIKEEQLPRLPYVNGVFHETLRKYSPAPLVPIRYAHEDTQIGGYHIPAGSEIAINIYGCNMDKKRWERPEEWWPERFLEDRYESSDLHKTMAFGAGKRVCAGALQASLMAGIAIGRLVQEFEWKLRDGEEENVDTYGLTSQKLYPLMAIINPRRS

SEQ ID NO: 69 - DNA, 1554 bp, Artificial Sequence
  Codon-optimized KO
aagcttactagtaaaatggacatgatgggtattgaagctgttccatttgctactgctgttgttttgggtggtatttccttggttgttttgatcttcatcagaagattcgtttccaacagaaagagatccgttgaaggtttgccaccagttccagatattccaggtttaccattgattggtaacttgttgcaattgaaagaaaagaagccacataagacctttgctagatgggctgaaacttacggtccaattttctctattagaactggtgcttctaccatgatcgtcttgaattcttctgaagttgccaaagaagctatggtcactagattctcttcaatctctaccagaaagttgtccaacgccttgaagattttgaccttcgataagtgtatggttgccacctctgattacaacgattttcacaaaatggtcaagggtttcatcttgagaaacgttttaggtgctccagcccaaaaaagacatagatgtcatagagataccttgatcgaaaacatctctaagtacttgcatgcccatgttaagacttctccattggaaccagttgtcttgaagaagattttcgaatccgaaattttcggtttggctttgaaacaagccttgggtaaggatatcgaatccatctatgttgaagaattgggtactaccttgtccagagaagaaatttttgccgttttggttgttgatccaatggctggtgctattgaagttgattggagagattttttcccatacttgtcctggattccaaacaagtctatggaaatgaagatccaaagaatggattttagaagaggtgctttgatgaaggccttgattggtgaacaaaagaaaagaatcggttccggtgaagaaaagaactcctacattgatttcttgttgtctgaagctaccactttgaccgaaaagcaaattgctatgttgatctgggaaaccatcatcgaaatttccgatacaactttggttacctctgaatgggctatgtacgaattggctaaagacccaaatagacaagaaatcttgtacagagaaatccacaaggtttgcggttctaacaagttgactgaagaaaacttgtccaagttgccatacttgaactctgttttccacgaaaccttgagaaagtattctccagctccaatggttccagttagatatgctcatgaagatactcaattgggtggttaccatattccagctggttctcaaattgccattaacatctacggttgcaacatgaacaaaaagcaatgggaaaatcctgaagaatggaagccagaaagattcttggacgaaaagtatgacttgatggacttgcataagactatggcttttggtggtggtaaaagagtttgtgctggtgctttacaagcaatgttgattgcttgcacttccatcggtagattcgttcaagaatttgaatggaagttgatgggtggtgaagaagaaaacgttgatactgttgctttgacctcccaaaaattgcatccaatgcaagccattattaaggccagagaatgactcgagccgcgg

SEQ ID NO: 70 - protein, 508 aa, Vitis vinifera
MDMMGIEAVPFATAVVLGGISLVVLIFIRRFVSNRKRSVEGLPPVPDIPGLPLIGNLLQLKEKKPHKTFARWAETYGPIFSIRTGASTMIVLNSSEVAKEAMVTRFSSISTRKLSNALKILTFDKCMVATSDYNDFHKMVKGFILRNVLGAPAQKRHRCHRDTLIENISKYLHAHVKTSPLEPVVLKKIFESEIFGLALKQALGKDIESIYVEELGTTLSREEIFAVLVVDPMAGAIEVDWRDFFPYLSWIPNKSMEMKIQRMDFRRGALMKALIGEQKKRIGSGEEKNSYIDFLLSEATTLTEKQIAMLIWETIIEISDTTLVTSEWAMYELAKDPNRQEILYREIHKVCGSNKLTEENLSKLPYLNSVFHETLRKYSPAPMVPVRYAHEDTQLGGYHIPAGSQIAINIYGCNMNKKQWENPEEWKPERFLDEKYDLMDLHKTMAFGGGKRVCAGALQAMLIACTSIGRFVQEFEWKLMGGEEENVDTVALTSQKLHPMQAIIKARE

SEQ ID NO: 71 - DNA, 1593 bp, Artificial Sequence
  Codon-optimized KO
aagcttaaaatgagtaagtctaatagtatgaattctacatcacacgaaaccctttttcaacaattggtcttgggtttggaccgtatgccattgatggatgttcactggttgatctacgttgctttcggcgcatggttatgttcttatgtgatacatgttttatcatcttcctctacagtaaaagtgccagttgttggatacaggtctgtattcgaacctacatggttgcttagacttagattcgtctgggaaggtggctctatcataggtcaagggtacaataagtttaaagactctattttccaagttaggaaattgggaactgatattgtcattataccacctaactatattgatgaagtgagaaaattgtcacaggacaagactagatcagttgaacctttcattaatgattttgcaggtcaatacacaagaggcatggttttcttgcaatctgacttacaaaaccgtgttatacaacaaagactaactccaaaattggtttccttgaccaaggtcatgaaggaagagttggattatgctttaacaaaagagatgcctgatatgaaaaatgacgaatgggtagaagtagatatcagtagtataatggtgagattgatttccaggatctccgccagagtctttctagggcctgaacactgtcgtaaccaggaatggttgactactacagcagaatattcagaatcacttttcattacagggtttatcttaagagttgtacctcatatcttaagaccattcatcgcccctctattaccttcatacaggactctacttagaaacgtttcaagtggtagaagagtcatcggtgacatcataagatctcagcaaggggatggtaacgaagatatactttcctggatgagagatgctgccacaggagaggaaaagcaaatcgataacattgctcagagaatgttaattctttctttagcatcaatccacactactgcgatgaccatgacacatgccatgtacgatctatgtgcttgccctgagtacattgaaccattaagagatgaagttaaatctgttgttggggcttctggctgggacaagacagcgttaaacagatttcataagttggactccttcctaaaagagtcacaaagattcaacccagtattcttattgacattcaatagaatctaccatcaatctatgaccttatcagatggcactaacattccatctggaacacgtattgctgttccatcacacgcaatgttgcaagattctgcacatgtcccaggtccaaccccacctactgaatttgatggattcagatatagtaagatacgttctgatagtaactacgcacaaaagtacctattctccatgaccgattcttcaaacatggctttcggatacggcaagtatgcttgtccaggtagattttacgcgtctaatgagatgaaactaacattagccattttgttgctacaatttgagttcaaactaccagatggtaaaggtcgtcctagaaatatcactatcgattctgatatgattccagacccaagagctagactttgcgtcagaaaaagatcacttagagatgaatgaccgcgg

SEQ ID NO: 72 - protein, 525 aa, Gibberella fujikuroi
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 73 - DNA, 1515 bp, Artificial Sequence
  Codon-optimized KO
aagcttaaaatggaagatcctactgtcttatatgcttgtcttgccattgcagttgcaactttcgttgttagatggtacagagatccattgagatccatcccaacagttggtggttccgatttgcctattctatcttacatcggcgcactaagatggacaagacgtggcagagagatacttcaagagggatatgatggctacagaggatctacattcaaaatcgcgatgttagaccgttggatcgtgatcgcaaatggtcctaaactagctgatgaagtcagacgtagaccagatgaagagttaaactttatggacggattaggagcattcgtccaaactaagtacaccttaggtgaagctattcataacgatccataccatgtcgatatcataagagaaaaactaacaagaggccttccagccgtgcttcctgatgtcattgaagagttgacacttgcggttagacagtacattccaacagaaggtgatgaatgggtgtccgtaaactgttcaaaggccgcaagagatattgttgctagagcttctaatagagtctttgtaggtttgcctgcttgcagaaaccaaggttacttagatttggcaatagactttacattgtctgttgtcaaggatagagccatcatcaatatgtttccagaattgttgaagccaatagttggcagagttgtaggtaacgccaccagaaatgttcgtagagctgttccttttgttgctccattggtggaggaaagacgtagacttatggaagagtacggtgaagactggtctgaaaaacctaatgatatgttacagtggataatggatgaagctgcatccagagatagttcagtgaaggcaatcgcagagagattgttaatggtgaacttcgcggctattcatacctcatcaaacactatcactcatgctttgtaccaccttgccgaaatgcctgaaactttgcaaccacttagagaagagatcgaaccattagtcaaagaggagggctggaccaaggctgctatgggaaaaatgtggtggttagattcatttctaagagaatctcaaagatacaatggcattaacatcgtatctttaactagaatggctgacaaagatattacattgagtgatggcacatttttgccaaaaggtactctagtggccgttccagcgtattctactcatagagatgatgctgtctacgctgatgccttagtattcgatcctttcagattctcacgtatgagagcgagagaaggtgaaggtacaaagcaccagttcgttaatacttcagtcgagtacgttccatttggtcacggaaagcatgcttgtccaggaagattcttcgccgcaaacgaattgaaagcaatgttggcttacattgttctaaactatgatgtaaagttgcctggtgacggtaaacgtccattgaacatgtattggggtccaacagttttgcctgcaccagcaggccaagtattgttcagaaagagacaagttagtctataaccgcgg

SEQ ID NO: 74 - protein, 499 aa, Trametes versicolor
MEDPTVLYACLAIAVATFVVRWYRDPLRSIPTVGGSDLPILSYIGALRWTRRGREILQEGYDGYRGSTFKIAMLDRWIVIANGPKLADEVRRRPDEELNFMDGLGAFVQTKYTLGEAIHNDPYHVDIIREKLTRGLPAVLPDVIEELTLAVRQYIPTEGDEWVSVNCSKAARDIVARASNRVFVGLPACRNQGYLDLAIDFTLSVVKDRAIINMFPELLKPIVGRVVGNATRNVRRAVPFVAPLVEERRRLMEEYGEDWSEKPNDMLQWIMDEAASRDSSVKAIAERLLMVNFAAIHTSSNTITHALYHLAEMPETLQPLREEIEPLVKEEGWTKAAMGKMWWLDSFLRESQRYNGINIVSLTRMADKDITLSDGTFLPKGTLVAVPAYSTHRDDAVYADALVFDPFRFSRMRAREGEGTKHQFVNTSVEYVPFGHGKHACPGRFFAANELKAMLAYIVLNYDVKLPGDGKRPLNMYWGPTVLPAPAGQVLFRKRQVSL

SEQ ID NO: 75 - DNA, 1530 bp, Artificial Sequence
  Codon-optimized KO
atggcatttttctctatgatttcaattttgttgggatttgttatttcttctttcatcttcatctttttcttcaaaaagttacttagttttagtaggaaaaacatgtcagaagtttctactttgccaagtgttccagtagtgcctggttttccagttattgggaatttgttgcaactaaaggagaaaaagcctcataaaactttcactagatggtcagagatatatggacctatctactctataaagatgggttcttcatctcttattgtattgaacagtacagaaactgctaaggaagcaatggtcactagattttcatcaatatctaccagaaaattgtcaaacgccctaacagttctaacctgcgataagtctatggtcgccacttctgattatgatgacttccacaaattagttaagagatgtttgctaaatggacttcttggtgctaatgctcaaaagagaaaaagacactacagagatgctttgattgaaaatgtgagttccaagctacatgcacacgctagagatcatccacaagagccagttaactttagagcaattttcgaacacgaattgtttggtgtagcattaaagcaagccttcggtaaagacgtagaatccatatacgtcaaggagttaggcgtaacattatcaaaagatgaaatctttaaggtgcttgtacatgatatgatggagggtgcaattgatgtagattggagagatttcttcccatatttgaaatggatccctaataagtcttttgaagctaggatacaacaaaagcacaagagaagactagctgttatgaacgcacttatacaggacagattgaagcaaaatgggtctgaatcagatgatgattgttaccttaacttcttaatgtctgaggctaaaacattgactaaggaacagatcgcaatccttgtctgggaaacaatcattgaaacagcagatactaccttagtcacaactgaatgggccatatacgagctagccaaacatccatctgtgcaagataggttgtgtaaggagatccagaacgtgtgtggtggagagaaattcaaggaagagcagttgtcacaagttccttaccttaacggcgttttccatgaaaccttgagaaaatactcacctgcaccattagttcctattagatacgcccacgaagatacacaaatcggtggctaccatgttccagctgggtccgaaattgctataaacatctacgggtgcaacatggacaaaaagagatgggaaagaccagaagattggtggccagaaagattcttagatgatggcaaatatgaaacatctgatttgcataaaacaatggctttcggagctggcaaaagagtgtgtgccggtgctctacaagcctccctaatggctggtatcgctattggtagattggtccaagagttcgaatggaaacttagagatggtgaagaggaaaatgtcgatacttatgggttaacatctcaaaagttatacccactaatggcaatcatcaatcctagaagatcctaa

SEQ ID NO: 76 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETAKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 77 - DNA, 2133 bp, Artificial Sequence
  Codon-optimized CPR
atgcaatcagattcagtcaaagtctctccatttgatttggtttccgctgctatgaatggcaaggcaatggaaaagttgaacgctagtgaatctgaagatccaacaacattgcctgcactaaagatgctagttgaaaatagagaattgttgacactgttcacaacttccttcgcagttcttattgggtgtcttgtatttctaatgtggagacgttcatcctctaaaaagctggtacaagatccagttccacaagttatcgttgtaaagaagaaagagaaggagtcagaggttgatgacgggaaaaagaaagtttctattttctacggcacacaaacaggaactgccgaaggttttgctaaagcattagtcgaggaagcaaaagtgagatatgaaaagacctctttcaaggttatcgatctagatgactacgctgcagatgatgatgaatatgaggaaaaactgaaaaaggaatccttagccttcttcttcttggccacatacggtgatggtgaacctactgataatgctgctaacttctacaagtggttcacagaaggcgacgataaaggtgaatggctgaaaaagttacaatacggagtatttggtttaggtaacagacaatatgaacatttcaacaagatcgctattgtagttgatgataaacttactgaaatgggagccaaaagattagtaccagtaggattaggggatgatgatcagtgtatagaagatgacttcaccgcctggaaggaattggtatggccagaattggatcaacttttaagggacgaagatgatacttctgtgactaccccatacactgcagccgtattggagtacagagtggtttaccatgataaaccagcagactcatatgctgaagatcaaacccatacaaacggtcatgttgttcatgatgcacagcatccttcaagatctaatgtggctttcaaaaaggaactacacacctctcaatcagataggtcttgtactcacttagaattcgatatttctcacacaggactgtcttacgaaactggcgatcacgttggcgtttattccgagaacttgtccgaagttgtcgatgaagcactaaaactgttagggttatcaccagacacatacttctcagtccatgctgataaggaggatgggacacctatcggtggtgcttcactaccaccaccttttcctccttgcacattgagagacgctctaaccagatacgcagatgtcttatcctcacctaaaaaggtagctttgctggcattggctgctcatgctagtgatcctagtgaagccgataggttaaagttcctggcttcaccagccggaaaagatgaatatgcacaatggatcgtcgccaaccaacgttctttgctagaagtgatgcaaagttttccatctgccaagcctccattaggtgtgttcttcgcagcagtagctccacgtttacaaccaagatactactctatcagttcatctcctaagatgtctcctaacagaatacatgttacatgtgctttggtgtacgagactactccagcaggcagaattcacagaggattgtgttcaacctggatgaaaaatgctgtccctttaacagagtcacctgattgctctcaagcatccattttcgttagaacatcaaatttcagacttccagtggatccaaaagttccagtcattatgataggaccaggcactggtcttgccccattcaggggctttcttcaagagagattggccttgaaggaatctggtacagaattgggttcttctatctttttctttggttgccgtaatagaaaagttgactttatctacgaggacgagcttaacaattttgttgagacaggagcattgtcagaattgatcgtcgcattttcaagagaagggactgccaaagagtacgttcagcacaagatgagtcaaaaagcctccgatatatggaaacttctaagtgaaggtgcctatctttatgtctgtggcgatgcaaagggcatggccaaggatgtccatagaactctgcatacaattgttcaggaacaagggagtctggattcttccaaggctgaattgtacgtcaaaaacttacagatgtctggaagatacttaagagatgtttggtaa

SEQ ID NO: 78 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 79 - DNA, 2106 bp, Siraitia grosvenorii
atgaaggtcagtccattcgaattcatgtccgctattatcaagggtagaatggacccatctaactcctcatttgaatctactggtgaagttgcctccgttatctttgaaaacagagaattggttgccatcttgaccacttctattgctgttatgattggttgcttcgttgtcttgatgtggagaagagctggttctagaaaggttaagaatgtcgaattgccaaagccattgattgtccatgaaccagaacctgaagttgaagatggtaagaagaaggtttccatcttcttcggtactcaaactggtactgctgaaggttttgctaaggctttggctgatgaagctaaagctagatacgaaaaggctaccttcagagttgttgatttggatgattatgctgccgatgatgaccaatacgaagaaaaattgaagaacgaatccttcgccgttttcttgttggctacttatggtgatggtgaacctactgataatgctgctagattttacaagtggttcgccgaaggtaaagaaagaggtgaatggttgcaaaacttgcactatgctgtttttggtttgggtaacagacaatacgaacacttcaacaagattgctaaggttgccgacgaattattggaagctcaaggtggtaatagattggttaaggttggtttaggtgatgacgatcaatgcatcgaagatgatttttctgcttggagagaatctttgtggccagaattggatatgttgttgagagatgaagatgatgctactactgttactactccatatactgctgctgtcttggaatacagagttgtctttcatgattctgctgatgttgctgctgaagataagtcttggattaacgctaatggtcatgctgttcatgatgctcaacatccattcagatctaacgttgtcgtcagaaaagaattgcatacttctgcctctgatagatcctgttctcatttggaattcaacatttccggttccgctttgaattacgaaactggtgatcatgttggtgtctactgtgaaaacttgactgaaactgttgatgaagccttgaacttgttgggtttgtctccagaaacttacttctctatctacaccgataacgaagatggtactccattgggtggttcttcattgccaccaccatttccatcatgtactttgagaactgctttgaccagatacgctgatttgttgaactctccaaaaaagtctgctttgttggctttagctgctcatgcttctaatccagttgaagctgatagattgagatacttggcttctccagctggtaaagatgaatatgcccaatctgttatcggttcccaaaagtctttgttggaagttatggctgaattcccatctgctaaaccaccattaggtgttttttttgctgctgttgctccaagattgcaacctagattctactccatttcatcctctccaagaatggctccatctagaatccatgttacttgtgctttggtttacgataagatgccaactggtagaattcataagggtgtttgttctacctggatgaagaattctgttccaatggaaaagtcccatgaatgttcttgggctccaattttcgttagacaatccaattttaagttgccagccgaatccaaggttccaattatcatggttggtccaggtactggtttggctccttttagaggttttttacaagaaagattggccttgaaagaatccggtgttgaattgggtccatccattttgtttttcggttgcagaaacagaagaatggattacatctacgaagatgaattgaacaacttcgttgaaaccggtgctttgtccgaattggttattgctttttctagagaaggtcctaccaaagaatacgtccaacataagatggctgaaaaggcttctgatatctggaacttgatttctgaaggtgcttacttgtacgtttgtggtgatgctaaaggtatggctaaggatgttcatagaaccttgcataccatcatgcaagaacaaggttctttggattcttccaaagctgaatccatggtcaagaacttgcaaatgaatggtagatacttaagagatgtttggtaa

SEQ ID NO: 80 - protein, 701 aa, Siraitia grosvenorii
MKVSPFEFMSAIIKGRMDPSNSSFESTGEVASVIFENRELVAILTTSIAVMIGCFVVLMWRRAGSRKVKNVELPKPLIVHEPEPEVEDGKKKVSIFFGTQTGTAEGFAKALADEAKARYEKATFRVVDLDDYAADDDQYEEKLKNESFAVFLLATYGDGEPTDNAARFYKWFAEGKERGEWLQNLHYAVFGLGNRQYEHFNKIAKVADELLEAQGGNRLVKVGLGDDDQCIEDDFSAWRESLWPELDMLLRDEDDATTVTTPYTAAVLEYRVVFHDSADVAAEDKSWINANGHAVHDAQHPFRSNVVVRKELHTSASDRSCSHLEFNISGSALNYETGDHVGVYCENLTETVDEALNLLGLSPETYFSIYTDNEDGTPLGGSSLPPPFPSCTLRTALTRYADLLNSPKKSALLALAAHASNPVEADRLRYLASPAGKDEYAQSVIGSQKSLLEVMAEFPSAKPPLGVFFAAVAPRLQPRFYSISSSPRMAPSRIHVTCALVYDKMPTGRIHKGVCSTWMKNSVPMEKSHECSWAPIFVRQSNFKLPAESKVPIIMVGPGTGLAPFRGFLQERLALKESGVELGPSILFFGCRNRRMDYIYEDELNNFVETGALSELVIAFSREGPTKEYVQHKMAEKASDIWNLISEGAYLYVCGDAKGMAKDVHRTLHTIMQEQGSLDSSKAESMVKNLQMNGRYLRDVW

SEQ ID NO: 81 - DNA, 2142 bp, Artificial Sequence
  Codon-optimized CPR
atggcagaattagatacacttgatatagtagtattaggtgttatctttttgggtactgtggcatactttactaagggtaaattgtggggtgttaccaaggatccatacgctaacggattcgctgcaggtggtgcttccaagcctggcagaactagaaacatcgtcgaagctatggaggaatcaggtaaaaactgtgttgttttctacggcagtcaaacaggtacagcggaggattacgcatcaagacttgcaaaggaaggaaagtccagattcggtttgaacactatgatcgccgatctagaagattatgacttcgataacttagacactgttccatctgataacatcgttatgtttgtattggctacttacggtgaaggcgaaccaacagataacgccgtggatttctatgagttcattactggcgaagatgcctctttcaatgagggcaacgatcctccactaggtaacttgaattacgttgcgttcggtctgggcaacaatacctacgaacactacaactcaatggtcaggaacgttaacaaggctctagaaaagttaggagctcatagaattggagaagcaggtgagggtgacgacggagctggaactatggaagaggactttttagcttggaaagatccaatgtgggaagccttggctaaaaagatgggcttggaggaaagagaagctgtatatgaacctattttcgctatcaatgagagagatgatttgacccctgaagcgaatgaggtatacttgggagaacctaataagctacacttggaaggtacagcgaaaggtccattcaactcccacaacccatatatcgcaccaattgcagaatcatacgaacttttctcagctaaggatagaaattgtctgcatatggaaattgatatttctggtagtaatctaaagtatgaaacaggcgaccatatcgcgatctggcctaccaacccaggtgaagaggtcaacaaatttcttgacattctagatctgtctggtaagcaacattccgtcgtaacagtgaaagccttagaacctacagccaaagttccttttccaaatccaactacctacgatgctatattgagataccatctggaaatatgcgctccagtttctagacagtttgtctcaactttagcagcattcgcccctaatgatgatatcaaagctgagatgaaccgtttgggatcagacaaagattacttccacgaaaagacaggaccacattactacaatatcgctagatttttggcctcagtctctaaaggtgaaaaatggacaaagataccattttctgctttcatagaaggccttacaaaactacaaccaagatactattctatctcttcctctagtttagttcagcctaaaaagattagtattactgctgttgtcgaatctcagcaaattccaggtagagatgacccattcagaggtgtagcgactaactacttgttcgctttgaagcagaaacaaaacggtgatccaaatccagctccttttggccaatcatacgagttgacaggaccaaggaataagtatgatggtatacatgttccagtccatgtaagacattctaactttaagctaccatctgatccaggcaaacctattatcatgatcggtccaggtaccggtgttgccccttttagaggcttcgtccaagagagggcaaaacaagccagagatggtgtagaagttggtaaaacactgctgttctttggatgtagaaagagtacagaagatttcatgtatcaaaaagagtggcaagagtacaaggaagctcttggcgacaaattcgaaatgattacagctttttcaagagaaggatctaaaaaggtttatgttcaacacagactgaaggaaagatcaaaggaagtttctgatcttctatcccaaaaagcatacttctacgtttgcggagacgccgcacatatggcacgtgaagtgaacactgtgttagcacagatcatagcagaaggccgtggtgtatcagaagccaagggtgaggaaattgtcaaaaacatgagatcagcaaatcaataccaagtgtgttctgatttcgtaactttacactgtaaagagacaacatacgcgaattcagaattgcaagaggatgtctggagttaa

SEQ ID NO: 82 - protein, 713 aa, Gibberella fujikuroi
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 83 - DNA, 2130 bp, Stevia rebaudiana
atgcaatcggaatccgttgaagcatcgacgattgatttgatgactgctgttttgaaggacacagtgatcgatacagcgaacgcatctgataacggagactcaaagatgccgccggcgttggcgatgatgttcgaaattcgtgatctgttgctgattttgactacgtcagttgctgttttggtcggatgtttcgttgttttggtgtggaagagatcgtccgggaagaagtccggcaaggaattggagccgccgaagatcgttgtgccgaagaggcggctggagcaggaggttgatgatggtaagaagaaggttacgattttcttcggaacacaaactggaacggctgaaggtttcgctaaggcacttttcgaagaagcgaaagcgcgatatgaaaaggcagcgtttaaagtgattgatttggatgattatgctgctgatttggatgagtatgcagagaagctgaagaaggaaacatatgctttcttcttcttggctacatatggagatggtgagccaactgataatgctgccaaattttataaatggtttactgagggagacgagaaaggcgtttggcttcaaaaacttcaatatggagtatttggtcttggcaacagacaatatgaacatttcaacaagattggaatagtggttgatgatggtctcaccgagcagggtgcaaaacgcattgttcccgttggtcttggagacgacgatcaatcaattgaagacgatttttcggcatggaaagagttagtgtggcccgaattggatctattgcttcgcgatgaagatgacaaagctgctgcaactccttacacagctgcaatccctgaataccgcgtcgtatttcatgacaaacccgatgcgttttctgatgatcatactcaaaccaatggtcatgctgttcatgatgctcaacatccatgcagatccaatgtggctgttaaaaaagagcttcatactcctgaatccgatcgttcatgcacacatcttgaatttgacatttctcacactggattatcttatgaaactggggatcatgttggtgtatactgtgaaaacctaattgaagtagtggaagaagctgggaaattgttaggattatcaacagatacttatttctcgttacatattgataacgaagatggttcaccacttggtggaccttcattacaacctccttttcctccttgtactttaagaaaagcattgactaattatgcagatctgttaagctctcccaaaaagtcaactttgcttgctctagctgctcatgcttccgatcccactgaagctgatcgtttaagatttcttgcatctcgcgagggcaaggatgaatatgctgaatgggttgttgcaaaccaaagaagtcttcttgaagtcatggaagctttcccgtcagctagaccgccacttggtgttttctttgcagcggttgcaccgcgtttacagcctcgttactactctatttcttcctccccaaagatggaaccaaacaggattcatgttacttgcgcgttggtttatgaaaaaactcccgcaggtcgtatccacaaaggaatctgctcaacctggatgaagaacgctgtacctttgaccgaaagtcaagattgcagttgggcaccgatttttgttagaacatcaaacttcagacttccaattgacccgaaagtcccggttatcatgattggtcctggaaccgggttggctccatttaggggttttcttcaagaaagattggctcttaaagaatccggaaccgaactcgggtcatctattttattcttcggttgtagaaaccgcaaagtggattacatatatgagaatgaactcaacaactttgttgaaaatggtgcgctttctgagcttgatgttgctttctcccgcgatggcccgacgaaagaatacgtgcaacataaaatgacccaaaaggcttctgaaatatggaatatgctttctgagggagcatatttatatgtatgtggtgatgctaaaggcatggctaaagatgtacaccgtacacttcacaccattgtgcaagaacagggaagtttggactcgtctaaagcggagttgtatgtgaagaatctacaaatgtcaggaagatacctccgtgatgtttggtaa

SEQ ID NO: 84 - protein, 709 aa, Stevia rebaudiana
MQSESVEASTIDLMTAVLKDTVIDTANASDNGDSKMPPALAMMFEIRDLLLILTTSVAVLVGCFVVLVWKRSSGKKSGKELEPPKIVVPKRRLEQEVDDGKKKVTIFFGTQTGTAEGFAKALFEEAKARYEKAAFKVIDLDDYAADLDEYAEKLKKETYAFFFLATYGDGEPTDNAAKFYKWFTEGDEKGVWLQKLQYGVFGLGNRQYEHFNKIGIVVDDGLTEQGAKRIVPVGLGDDDQSIEDDFSAWKELVWPELDLLLRDEDDKAAATPYTAAIPEYRVVFHDKPDAFSDDHTQTNGHAVHDAQHPCRSNVAVKKELHTPESDRSCTHLEFDISHTGLSYETGDHVGVYCENLIEVVEEAGKLLGLSTDTYFSLHIDNEDGSPLGGPSLQPPFPPCTLRKALTNYADLLSSPKKSTLLALAAHASDPTEADRLRFLASREGKDEYAEWVVANQRSLLEVMEAFPSARPPLGVFFAAVAPRLQPRYYSISSSPKMEPNRIHVTCALVYEKTPAGRIHKGICSTWMKNAVPLTESQDCSWAPIFVRTSNFRLPIDPKVPVIMIGPGTGLAPFRGFLQERLALKESGTELGSSILFFGCRNRKVDYIYENELNNFVENGALSELDVAFSRDGPTKEYVQHKMTQKASEIWNMLSEGAYLYVCGDAKGMAKDVHRTLHTIVQEQGSLDSSKAELYVKNLQMSGRYLRDVW

SEQ ID NO: 85 - DNA, 2124 bp, Artificial Sequence
  Codon-optimized CPR
atgcaatctaactccgtgaagatttcgccgcttgatctggtaactgcgctgtttagcggcaaggttttggacacatcgaacgcatcggaatcgggagaatctgctatgctgccgactatagcgatgattatggagaatcgtgagctgttgatgatactcacaacgtcggttgctgtattgatcggatgcgttgtcgttttggtgtggcggagatcgtctacgaagaagtcggcgttggagccaccggtgattgtggttccgaagagagtgcaagaggaggaagttgatgatggtaagaagaaagttacggttttcttcggcacccaaactggaacagctgaaggcttcgctaaggcacttgttgaggaagctaaagctcgatatgaaaaggctgtctttaaagtaattgatttggatgattatgctgctgatgacgatgagtatgaggagaaactaaagaaagaatctttggcctttttctttttggctacgtatggagatggtgagccaacagataatgctgccagattttataaatggtttactgagggagatgcgaaaggagaatggcttaataagcttcaatatggagtatttggtttgggtaacagacaatatgaacattttaacaagatcgcaaaagtggttgatgatggtcttgtagaacagggtgcaaagcgtcttgttcctgttggacttggagatgatgatcaatgtattgaagatgacttcaccgcatggaaagagttagtatggccggagttggatcaattacttcgtgatgaggatgacacaactgttgctactccatacacagctgctgttgcagaatatcgcgttgtttttcatgaaaaaccagacgcgctttctgaagattatagttatacaaatggccatgctgttcatgatgctcaacatccatgcagatccaacgtggctgtcaaaaaggaacttcatagtcctgaatctgaccggtcttgcactcatcttgaatttgacatctcgaacaccggactatcatatgaaactggggaccatgttggagtttactgtgaaaacttgagtgaagttgtgaatgatgctgaaagattagtaggattaccaccagacacttactcctccatccacactgatagtgaagacgggtcgccacttggcggagcctcattgccgcctcctttcccgccatgcactttaaggaaagcattgacgtgttatgctgatgttttgagttctcccaagaagtcggctttgcttgcactagctgctcatgccaccgatcccagtgaagctgatagattgaaatttcttgcatcccccgccggaaaggatgaatattctcaatggatagttgcaagccaaagaagtctccttgaagtcatggaagcattcccgtcagctaagccttcacttggtgttttctttgcatctgttgccccgcgcttacaaccaagatactactctatttcttcctcacccaagatggcaccggataggattcatgttacatgtgcattagtctatgagaaaacacctgcaggccgcatccacaaaggagtttgttcaacttggatgaagaacgcagtgcctatgaccgagagtcaagattgcagttgggccccaatatacgtccgaacatccaatttcagactaccatctgaccctaaggtcccggttatcatgattggacctggcactggtttggctccttttagaggtttccttcaagagcggttagctttaaaggaagccggaactgacctcggtttatccattttattcttcggatgtaggaatcgcaaagtggatttcatatatgaaaacgagcttaacaactttgtggagactggtgctctttctgagcttattgttgctttctcccgtgaaggcccgactaaggaatatgtgcaacacaagatgagtgagaaggcttcggatatctggaacttgctttctgaaggagcatatttatacgtatgtggtgatgccaaaggcatggccaaagatgtacatcgaaccctccacacaattgtgcaagaacagggatctcttgactcgtcaaaggcagaactctacgtgaagaatctacaaatgtcaggaagatacctccgtgacgtttggtaa

SEQ ID NO: 86 - protein, 707 aa, Stevia rebaudiana
MQSNSVKISPLDLVTALFSGKVLDTSNASESGESAMLPTIAMIMENRELLMILTTSVAVLIGCVVVLVWRRSSTKKSALEPPVIVVPKRVQEEEVDDGKKKVTVFFGTQTGTAEGFAKALVEEAKARYEKAVFKVIDLDDYAADDDEYEEKLKKESLAFFFLATYGDGEPTDNAARFYKWFTEGDAKGEWLNKLQYGVFGLGNRQYEHFNKIAKVVDDGLVEQGAKRLVPVGLGDDDQCIEDDFTAWKELVWPELDQLLRDEDDTTVATPYTAAVAEYRVVFHEKPDALSEDYSYTNGHAVHDAQHPCRSNVAVKKELHSPESDRSCTHLEFDISNTGLSYETGDHVGVYCENLSEVVNDAERLVGLPPDTYSSIHTDSEDGSPLGGASLPPPFPPCTLRKALTCYADVLSSPKKSALLALAAHATDPSEADRLKFLASPAGKDEYSQWIVASQRSLLEVMEAFPSAKPSLGVFFASVAPRLQPRYYSISSSPKMAPDRIHVTCALVYEKTPAGRIHKGVCSTWMKNAVPMTESQDCSWAPIYVRTSNFRLPSDPKVPVIMIGPGTGLAPFRGFLQERLALKEAGTDLGLSILFFGCRNRKVDFIYENELNNFVETGALSELIVAFSREGPTKEYVQHKMSEKASDIWNLLSEGAYLYVCGDAKGMAKDVHRTLHTIVQEQGSLDSSKAELYVKNLQMSGRYLRDVW

SEQ ID NO: 87 - DNA, 2070 bp, Artificial Sequence
  Codon-optimized CPR
atgtcctccaactccgatttggtcagaagattggaatctgttttgggtgtttctttcggtggttctgttactgattccgttgttgttattgctaccacctctattgctttggttatcggtgttttggttttgttgtggagaagatcctctgacagatctagagaagttaagcaattggctgttccaaagccagttactatcgttgaagaagaagatgaattcgaagttgcttctggtaagaccagagtttctattttctacggtactcaaactggtactgctgaaggttttgctaaggctttggctgaagaaatcaaagccagatacgaaaaagctgccgttaaggttattgatttggatgattacacagccgaagatgacaaatacggtgaaaagttgaagaaagaaactatggccttcttcatgttggctacttatggtgatggtgaacctactgataatgctgctagattttacaagtggttcaccgaaggtactgatagaggtgtttggttggaacatttgagatacggtgtattcggtttgggtaacagacaatacgaacacttcaacaagattgccaaggttgttgatgatttgttggttgaacaaggtgccaagagattggttactgttggtttgggtgatgatgatcaatgcatcgaagatgatttctccgcttggaaagaagccttgtggccagaattggatcaattattgcaagatgataccaacaccgtttctactccatacactgctgttattccagaatacagagttgttatccacgatccatctgttacctcttatgaagatccatactctaacatggctaacggtaatgcctcttacgatattcatcatccatgtagagctaacgttgccgtccaaaaagaattgcataagccagaatctgacagaagttgcatccatttggaattcgatattttcgctactggtttgacttacgaaaccggtgatcatgttggtgtttacgctgataattgtgatgatactgtagaagaagccgctaagttgttgggtcaaccattggatttgttgttctccattcataccgataacaacgacggtacttctttgggttcttctttgccaccaccatttccaggtccatgtactttgagaactgctttggctagatatgccgatttgttgaatccaccaaaaaaggctgctttgattgctttagctgctcatgctgatgaaccatctgaagctgaaagattgaagttcttgtcatctccacaaggtaaggacgaatattctaaatgggttgtcggttcccaaagatccttggttgaagttatggctgaatttccatctgctaaaccaccattgggtgtattttttgctgctgttgttcctagattgcaacctagatattactccatctcttccagtccaagatttgctccacatagagttcatgttacttgcgctttggtttatggtccaactccaactggtagaattcacagaggtgtatgttcattctggatgaagaatgttgtcccattggaaaagtctcaaaactgttcttgggccccaattttcatcagacaatctaatttcaagttgccagccgatcattctgttccaatagttatggttggtccaggtactggtttagctccttttagaggtttcttacaagaaagattggccttgaaagaagaaggtgctcaagttggtcctgctttgttgttttttggttgcagaaacagacaaatggacttcatctacgaagtcgaattgaacaactttgtcgaacaaggtgctttgtccgaattgatcgttgctttttcaagagaaggtccatccaaagaatacgtccaacataagatggttgaaaaggcagcttacatgtggaacttgatttctcaaggtggttacttctacgtttgtggtgatgctaaaggtatggctagagatgttcatagaacattgcataccatcgtccaacaagaagaaaaggttgattctaccaaggccgaatccatcgttaagaaattgcaaatggacggtagatacttgagagatgtttggtga

SEQ ID NO: 88 - protein, 689 aa, Rubus suavissimus
MSSNSDLVRRLESVLGVSFGGSVTDSVVVIATTSIALVIGVLVLLWRRSSDRSREVKQLAVPKPVTIVEEEDEFEVASGKTRVSIFYGTQTGTAEGFAKALAEEIKARYEKAAVKVIDLDDYTAEDDKYGEKLKKETMAFFMLATYGDGEPTDNAARFYKWFTEGTDRGVWLEHLRYGVFGLGNRQYEHFNKIAKVVDDLLVEQGAKRLVTVGLGDDDQCIEDDFSAWKEALWPELDQLLQDDTNTVSTPYTAVIPEYRVVIHDPSVTSYEDPYSNMANGNASYDIHHPCRANVAVQKELHKPESDRSCIHLEFDIFATGLTYETGDHVGVYADNCDDTVEEAAKLLGQPLDLLFSIHTDNNDGTSLGSSLPPPFPGPCTLRTALARYADLLNPPKKAALIALAAHADEPSEAERLKFLSSPQGKDEYSKWVVGSQRSLVEVMAEFPSAKPPLGVFFAAVVPRLQPRYYSISSSPRFAPHRVHVTCALVYGPTPTGRIHRGVCSFWMKNVVPLEKSQNCSWAPIFIRQSNFKLPADHSVPIVMVGPGTGLAPFRGFLQERLALKEEGAQVGPALLFFGCRNRQMDFIYEVELNNFVEQGALSELIVAFSREGPSKEYVQHKMVEKAAYMWNLISQGGYFYVCGDAKGMARDVHRTLHTIVQQEEKVDSTKAESIVKKLQMDGRYLRDVW

SEQ ID NO: 89 - DNA, 2079 bp, Artificial Sequence
  Codon-optimized CPR
atgacttctgcactttatgcctccgatcttttcaaacaattgaaaagtatcatgggaacggattctttgtccgatgatgttgtattagttattgctacaacttctctggcactggttgctggtttcgttgtcttattgtggaaaaagaccacggcagatcgttccggcgagctaaagccactaatgatccctaagtctctgatggcgaaagatgaggatgatgacttagatctaggttctggaaaaacgagagtctctatcttcttcggcacacaaaccggaacagccgaaggattcgctaaagcactttcagaagagatcaaagcaagatacgaaaaggcggctgtaaaagtaatcgatttggatgattacgctgccgatgatgaccaatatgaggaaaagttgaaaaaggaaacattggctttcttttgtgtagccacgtatggtgatggtgaaccaaccgataacgccgcaagattctacaagtggtttactgaagagaacgaaagagatatcaagttgcagcaacttgcttacggcgtttttgccttaggtaacagacaatacgagcactttaacaagataggtattgtcttagatgaagagttatgcaaaaagggtgcgaagagattgattgaagtcggtttaggagatgatgatcaatctatcgaggatgactttaatgcatggaaggaatctttgtggtctgaattagataagttacttaaggacgaagatgataaatccgttgccactccatacacagccgtcattccagaatatagagtagttactcatgatccaagattcacaacacagaaatcaatggaaagtaatgtggctaatggtaatactaccatcgatattcatcatccatgtagagtagacgttgcagttcaaaaggaattgcacactcatgaatcagacagatcttgcatacatcttgaatttgatatatcacgtactggtatcacttacgaaacaggtgatcacgtgggtgtctacgctgaaaaccatgttgaaattgtagaggaagctggaaagttgttgggccatagtttagatcttgttttctcaattcatgccgataaagaggatggctcaccactagaaagtgcagtgcctccaccatttccaggaccatgcaccctaggtaccggtttagctcgttacgcggatctgttaaatcctccacgtaaatcagctctagtggccttggctgcgtacgccacagaaccttctgaggcagaaaaactgaaacatctaacttcaccagatggtaaggatgaatactcacaatggatagtagctagtcaacgttctttactagaagttatggctgctttcccatccgctaaacctcctttgggtgttttcttcgccgcaatagcgcctagactgcaaccaagatactattcaatttcatcctcacctagactggcaccatcaagagttcatgtcacatccgctttagtgtacggtccaactcctactggtagaatccataagggcgtttgttcaacatggatgaaaaacgcggttccagcagagaagtctcacgaatgttctggtgctccaatctttatcagagcctccaacttcaaactgccttccaatccttctactcctattgtcatggtcggtcctggtacaggtcttgctccattcagaggtttcttacaagagagaatggccttaaaggaggatggtgaagagttgggatcttctttgttgtttttcggctgtagaaacagacaaatggatttcatctacgaagatgaactgaataactttgtagatcaaggagttatttcagagttgataatggctttttctagagaaggtgctcagaaggagtacgtccaacacaaaatgatggaaaaggccgcacaagtttgggacttaatcaaagaggaaggctatctatatgtctgtggtgatgcaaagggtatggcaagagatgttcacagaacacttcatactatagtccaggaacaggaaggcgttagttcttctgaagcggaagcaattgtgaaaaagttacaaacagagggaagatacttgagagatgtgtggtaa

SEQ ID NO: 90 - protein, 692 aa, Arabidopsis thaliana [sequence omitted]

SEQ ID NO: 91 - DNA, 2139 bp, Artificial Sequence
  Codon-optimized CPR
atgtcttcctcttcctcttccagtacctctatgattgatttgatggctgctattattaaaggtgaaccagttatcgtctccgacccagcaaatgcctctgcttatgaatcagttgctgcagaattgtcttcaatgttgatcgaaaacagacaattcgccatgatcgtaactacatcaatcgctgttttgatcggttgtattgtcatgttggtatggagaagatccggtagtggtaattctaaaagagtcgaacctttgaaaccattagtaattaagccaagagaagaagaaatagatgacggtagaaagaaagttacaatatttttcggtacccaaactggtacagctgaaggttttgcaaaagccttaggtgaagaagctaaggcaagatacgaaaagactagattcaagatagtcgatttggatgactatgccgctgatgacgatgaatacgaagaaaagttgaagaaagaagatgttgcatttttctttttggcaacctatggtgacggtgaaccaactgacaatgcagccagattctacaaatggtttacagagggtaatgatcgtggtgaatggttgaaaaacttaaagtacggtgttttcggtttgggtaacagacaatacgaacatttcaacaaagttgcaaaggttgtcgacgatattttggtcgaacaaggtgctcaaagattagtccaagtaggtttgggtgacgatgaccaatgtatagaagatgactttactgcctggagagaagctttgtggcctgaattagacacaatcttgagagaagaaggtgacaccgccgttgctaccccatatactgctgcagtattagaatacagagtttccatccatgatagtgaagacgcaaagtttaatgatatcactttggccaatggtaacggttatacagttttcgatgcacaacacccttacaaagctaacgttgcagtcaagagagaattacatacaccagaatccgacagaagttgtatacacttggaatttgatatcgctggttccggtttaaccatgaagttgggtgaccatgtaggtgttttatgcgacaatttgtctgaaactgttgatgaagcattgagattgttggatatgtcccctgacacttattttagtttgcacgctgaaaaagaagatggtacaccaatttccagttctttaccacctccattccctccatgtaacttaagaacagccttgaccagatacgcttgcttgttatcatcccctaaaaagtccgccttggttgctttagccgctcatgctagtgatcctactgaagcagaaagattgaaacacttagcatctccagccggtaaagatgaatattcaaagtgggtagttgaatctcaaagatcattgttagaagttatggcagaatttccatctgccaagcctccattaggtgtcttctttgctggtgtagcacctagattgcaaccaagattctactcaatcagttcttcacctaagatcgctgaaactagaattcatgttacatgtgcattagtctacgaaaagatgccaaccggtagaattcacaagggtgtatgctctacttggatgaaaaatgctgttccttacgaaaaatcagaaaagttgttcttaggtagaccaatcttcgtaagacaatcaaacttcaagttgccttctgattcaaaggttccaataatcatgataggtcctggtacaggtttagccccattcagaggtttcttgcaagaaagattggctttagttgaatctggtgtcgaattaggtccttcagttttgttctttggttgtagaaacagaagaatggatttcatctatgaagaagaattgcaaagattcgtcgaatctggtgcattggccgaattatctgtagctttttcaagagaaggtccaactaaggaatacgttcaacataagatgatggataaggcatccgacatatggaacatgatcagtcaaggtgcttatttgtacgtttgcggtgacgcaaagggtatggccagagatgtccatagatctttgcacacaattgctcaagaacaaggttccatggatagtaccaaagctgaaggtttcgtaaagaacttacaaacttccggtagatacttgagagatgtctggtga

SEQ ID NO: 92 - protein, 712 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 93 - DNA, 1503 bp, Artificial Sequence
  Codon-optimized KAH
atggaagcctcttacctatacatttctattttgcttttactggcatcatacctgttcaccactcaacttagaaggaagagcgctaatctaccaccaaccgtgtttccatcaataccaatcattggacacttatacttactcaaaaagcctctttatagaactttagcaaaaattgccgctaagtacggaccaatactgcaattacaactcggctacagacgtgttctggtgatttcctcaccatcagcagcagaagagtgctttaccaataacgatgtaatcttcgcaaatagacctaagacattgtttggcaaaatagtgggtggaacatcccttggcagtttatcctacggcgatcaatggcgtaatctaaggagagtagcttctatcgaaatcctatcagttcataggttgaacgaatttcatgatatcagagtggatgagaacagattgttaattagaaaacttagaagttcatcttctcctgttactcttataacagtcttttatgctctaacattgaacgtcattatgagaatgatctctggcaaaagatatttcgacagtggggatagagaattggaggaggaaggtaagagatttcgagaaatcttagacgaaacgttgcttctagccggtgcttctaatgttggcgactacttaccaatattgaactggttgggagttaagtctcttgaaaagaaattgatcgctttgcagaaaaagagagatgactttttccagggtttgattgaacaggttagaaaatctcgtggtgctaaagtaggcaaaggtagaaaaacgatgatcgaactcttattatctttgcaagagtcagaacctgagtactatacagatgctatgataagatcttttgtcctaggtctgctggctgcaggtagtgatacttcagcgggcactatggaatgggccatgagcttactggtcaatcacccacatgtattgaagaaagctcaagctgaaatcgatagagttatcggtaataacagattgattgacgagtcagacattggaaatatcccttacatcgggtgtattatcaatgaaactctaagactctatccagcagggccattgttgttcccacatgaaagttctgccgactgcgttatttccggttacaatatacctagaggtacaatgttaatcgtaaaccaatgggcgattcatcacgatcctaaagtctgggatgatcctgaaacctttaaacctgaaagatttcaaggattagaaggaactagagatggtttcaaacttatgccattcggttctgggagaagaggatgtccaggtgaaggtttggcaataaggctgttagggatgacactaggctcagtgatccaatgttttgattgggagagagtaggagatgagatggttgacatgacagaaggtttgggtgtcacacttcctaaggccgttccattagttgccaaatgtaagccacgttccgaaatgactaatctcctatccgaactttaa

SEQ ID NO: 94 - protein, 500 aa, Stevia rebaudiana
MEASYLYISILLLLASYLFTTQLRRKSANLPPTVFPSIPIIGHLYLLKKPLYRTLAKIAAKYGPILQLQLGYRRVLVISSPSAAEECFTNNDVIFANRPKTLFGKIVGGTSLGSLSYGDQWRNLRRVASIEILSVHRLNEFHDIRVDENRLLIRKLRSSSSPVTLITVFYALTLNVIMRMISGKRYFDSGDRELEEEGKRFREILDETLLLAGASNVGDYLPILNWLGVKSLEKKLIALQKKRDDFFQGLIEQVRKSRGAKVGKGRKTMIELLLSLQESEPEYYTDAMIRSFVLGLLAAGSDTSAGTMEWAMSLLVNHPHVLKKAQAEIDRVIGNNRLIDESDIGNIPYIGCIINETLRLYPAGPLLFPHESSADCVISGYNIPRGTMLIVNQWAIHHDPKVWDDPETFKPERFQGLEGTRDGFKLMPFGSGRRGCPGEGLAIRLLGMTLGSVIQCFDWERVGDEMVDMTEGLGVTLPKAVPLVAKCKPRSEMTNLLSEL

SEQ ID NO: 95 - DNA, 1572 bp, Rubus suavissimus
atggaagtaacagtagctagtagtgtagccctgagcctggtctttattagcatagtagtaagatgggcatggagtgtggtgaattgggtgtggtttaagccgaagaagctggaaagatttttgagggagcaaggccttaaaggcaattcctacaggtttttatatggagacatgaaggagaactctatcctgctcaaacaagcaagatccaaacccatgaacctctccacctcccatgacatagcacctcaagtcaccccttttgtcgaccaaaccgtgaaagcttacggtaagaactcttttaattgggttggccccataccaagggtgaacataatgaatccagaagatttgaaggacgtcttaacaaaaaatgttgactttgttaagccaatatcaaacccacttatcaagttgctagctacaggtattgcaatctatgaaggtgagaaatggactaaacacagaaggattatcaacccaacattccattcggagaggctaaagcgtatgttaccttcatttcaccaaagttgtaatgagatggtcaaggaatgggagagcttggtgtcaaaagagggttcatcatgtgagttggatgtctggccttttcttgaaaatatgtcggcagatgtgatctcgagaacagcatttggaactagctacaaaaaaggacagaaaatctttgaactcttgagagagcaagtaatatatgtaacgaaaggctttcaaagtttttacattccaggatggaggtttctcccaactaagatgaacaagaggatgaatgagattaacgaagaaataaaaggattaatcaggggtattataattgacagagagcaaatcattaaggcaggtgaagaaaccaacgatgacttattaggtgcacttatggagtcaaacttgaaggacattcgggaacatgggaaaaacaacaaaaatgttgggatgagtattgaagatgtaattcaggagtgtaagctgttttactttgctgggcaagaaaccacttcagtgttgctggcttggacaatggttttacttggtcaaaatcagaactggcaagatcgagcaagacaagaggttttgcaagtctttggaagcagcaagccagattttgatggtctagctcaccttaaagtcgtaaccatgattttgcttgaagttcttcgattatacccaccagtcattgaacttattcgaaccattcacaagaaaacacaacttgggaagctctcactaccagaaggagttgaagtccgcttaccaacactgctcattcaccatgacaaggaactgtggggtgatgatgcaaaccagttcaatccagagaggttttcggaaggagtttccaaagcaacaaagaaccgactctcattcttccccttcggagccggtccacgcatttgcattggacagaacttttctatgatggaagcaaagttggccttagcattgatcttgcaacacttcacctttgagctttctccatctcatgcacatgctccttcccatcgtataacccttcaaccacagtatggtgttcgtatcattttacatcgacgttag

SEQ ID NO: 96 - DNA, 1572 bp, Artificial Sequence
  Codon-optimized KAH
atggaagtcactgtcgcctcttctgtcgctttatccttagtcttcatttccattgtcgtcagatgggcttggtccgttgtcaactgggtttggttcaaaccaaagaagttggaaagattcttgagagagcaaggtttgaagggtaattcttatagattcttgtacggtgacatgaaggaaaattctattttgttgaagcaagccagatccaaaccaatgaacttgtctacctctcatgatattgctccacaagttactccattcgtcgatcaaactgttaaagcctacggtaagaactctttcaattgggttggtccaattcctagagttaacatcatgaacccagaagatttgaaggatgtcttgaccaagaacgttgacttcgttaagccaatttccaacccattgattaaattgttggctactggtattgccatttacgaaggtgaaaagtggactaagcatagaagaatcatcaaccctaccttccactctgaaagattgaagagaatgttaccatctttccatcaatcctgtaatgaaatggttaaggaatgggaatccttggtttctaaagaaggttcttcttgcgaattggatgtttggccattcttggaaaatatgtctgctgatgtcatttccagaaccgctttcggtacctcctacaagaagggtcaaaagattttcgaattgttgagagagcaagttatttacgttaccaagggtttccaatccttctacatcccaggttggagattcttgccaactaaaatgaacaagcgtatgaacgagatcaacgaagaaattaaaggtttgatcagaggtattattatcgacagagaacaaattattaaagctggtgaagaaaccaacgatgatttgttgggtgctttgatggagtccaacttgaaggatattagagaacatggtaagaacaacaagaatgttggtatgtctattgaagatgttattcaagaatgtaagttattctacttcgctggtcaagagaccacttctgttttgttagcctggactatggtcttgttaggtcaaaaccaaaattggcaagatagagctagacaagaagttttgcaagtcttcggttcttccaagccagactttgatggtttggcccacttgaaggttgttactatgattttgttagaagttttgagattgtacccaccagtcattgagttaatcagaaccattcataaaaagactcaattgggtaaattatctttgccagaaggtgttgaagtcagattaccaaccttgttgattcaccacgataaggaattatggggtgacgacgctaatcaatttaatccagaaagattttccgaaggtgtttccaaggctaccaaaaaccgtttgtccttcttcccatttggtgctggtccacgtatttgtatcggtcaaaacttttccatgatggaagccaagttggctttggctttaatcttgcaacacttcactttcgaattgtctccatcccatgcccacgctccttctcatagaatcactttacaaccacaatacggtgtcagaatcatcttacacagaagataa

SEQ ID NO: 97 - protein, 523 aa, Rubus suavissimus
MEVTVASSVALSLVFISIVVRWAWSVVNWVWFKPKKLERFLREQGLKGNSYRFLYGDMKENSILLKQARSKPMNLSTSHDIAPQVTPFVDQTVKAYGKNSFNWVGPIPRVNIMNPEDLKDVLTKNVDFVKPISNPLIKLLATGIAIYEGEKWTKHRRIINPTFHSERLKRMLPSFHQSCNEMVKEWESLVSKEGSSCELDVWPFLENMSADVISRTAFGTSYKKGQKIFELLREQVIYVTKGFQSFYIPGWRFLPTKMNKRMNEINEEIKGLIRGIIIDREQIIKAGEETNDDLLGALMESNLKDIREHGKNNKNVGMSIEDVIQECKLFYFAGQETTSVLLAWTMVLLGQNQNWQDRARQEVLQVFGSSKPDFDGLAHLKVVTMILLEVLRLYPPVIELIRTIHKKTQLGKLSLPEGVEVRLPTLLIHHDKELWGDDANQFNPERFSEGVSKATKNRLSFFPFGAGPRICIGQNFSMMEAKLALALILQHFTFELSPSHAHAPSHRITLQPQYGVRIILHRR

SEQ ID NO: 98 - DNA, 1566 bp, Prunus avium
atggaagcatcaagggctagttgtgttgcgctatgtgttgtttgggtgagcatagtaattacattggcatggagggtgctgaattgggtgtggttgaggccaaagaaactagaaagatgcttgagggagcaaggccttacaggcaattcttacaggcttttgtttggagacaccaaggatctctcgaagatgctggaacaaacacaatccaaacccatcaaactctccacctcccatgatatagcgccacgagtcaccccatttttccatcgaactgtgaactctaatggcaagaattcttttgtttggatgggccctataccaagagtgcacatcatgaatccagaagatttgaaagatgccttcaacagacatgatgattttcataagacagtaaaaaatcctatcatgaagtctccaccaccgggcattgtaggcattgaaggtgagcaatgggctaaacacagaaagattatcaacccagcattccatttagagaagctaaagggtatggtaccaatattttaccaaagttgtagcgagatgattaacaaatgggagagcttggtgtccaaagagagttcatgtgagttggatgtgtggccttatcttgaaaattttaccagcgatgtgatttcccgagctgcatttggaagtagctatgaagagggaaggaaaatatttcaactactaagagaggaagcaaaagtttattcggtagctctacgaagtgtttacattccaggatggaggtttctaccaaccaagcagaacaagaagacgaaggaaattcacaatgaaattaaaggcttacttaagggcattataaataaaagggaagaggcgatgaaggcaggggaagccactaaagatgacttactaggaatacttatggagtccaacttcagggaaattcaggaacatgggaacaacaaaaatgctggaatgagtattgaagatgtaattggagagtgtaagttgttttactttgctgggcaagagaccacttcggtgttgcttgtttggacaatgattttactaagccaaaatcaggattggcaagctcgtgcaagagaagaggtcttgaaagtctttggaagcaacatcccaacctatgaagagctaagtcacctaaaagttgtgaccatgattttacttgaagttcttcgattatacccatcagtcgttgcgcttcctcgaaccactcacaagaaaacacagcttggaaaattatcattaccagctggagtggaagtctccttgcccatactgcttgttcaccatgacaaagagttgtggggtgaggatgcaaatgagttcaagccagagaggttttcagagggagtttcaaaggcaacaaagaacaaatttacatacttacctttcggagggggtccaaggatttgcattggacaaaactttgccatggtggaagctaaattggccttggccctgattttacaacactttgcctttgagctttctccatcctatgctcatgctccttctgcagttataacccttcaacctcaatttggtgctcatatcattttgcataaacgttga

SEQ ID NO: 99 - DNA, 1567 bp, Artificial Sequence
  Codon-optimized KAH
atggaagcttctagagcatcttgtgttgctttgtgtgttgtttgggtttccatcgttattactttggcttggagagttttgaattgggtctggttaagaccaaaaaagttggaaagatgcttgagagaacaaggtttgactggtaactcttacagattgttgttcggtgataccaaggacttgtctaagatgttggaacaaactcaatccaagcctatcaagttgtctacctctcatgatattgctccaagagttactccattcttccatagaactgttaactccaacggtaagaactcttttgtttggatgggtccaattccaagagtccatattatgaaccctgaagatttgaaggacgctttcaacagacatgatgatttccataagaccgtcaagaacccaattatgaagtctccaccaccaggtatagttggtattgaaggtgaacaatgggccaaacatagaaagattattaacccagccttccacttggaaaagttgaaaggtatggttccaatcttctaccaatcctgctctgaaatgattaacaagtgggaatccttggtttccaaagaatcttcctgtgaattggatgtctggccatatttggaaaacttcacctccgatgttatttccagagctgcttttggttcttcttacgaagaaggtagaaagatcttccaattattgagagaagaagccaaggtttactccgttgctttgagatctgtttacattccaggttggagattcttgccaactaagcaaaacaaaaagaccaaagaaatccacaacgaaatcaagggtttgttgaagggtatcatcaacaagagagaagaagctatgaaggctggtgaagctacaaaagatgatttgttgggtatcttgatggaatccaacttcagagaaatccaagaacacggtaacaacaagaatgccggtatgtctattgaagatgttatcggtgaatgcaagttgttctactttgctggtcaagaaactacctccgttttgttggtttggaccatgattttgttgtcccaaaatcaagattggcaagctagagctagagaagaagtcttgaaagttttcggttctaacatcccaacctacgaagaattgtctcacttgaaggttgtcactatgatcttgttggaagtattgagattatacccatccgttgttgcattgccaagaactactcataagaaaactcaattgggtaaattgtccttgccagctggtgttgaagtttctttgccaattttgttagtccaccacgacaaagaattgtggggtgaagatgctaatgaattcaagccagaaagattctccgaaggtgtttctaaagctaccaagaacaagttcacttacttgccatttggtggtggtccaagaatatgtattggtcaaaatttcgctatggtcgaagctaaattggctttggctttgatcttgcaacatttcgctttcgaattgtcaccatcttatgctcatgctccatctgctgttattacattgcaaccacaatttggtgcccatatcatcttgcataagagataac

SEQ ID NO: 100 - protein, 521 aa, Prunus avium
MEASRASCVALCVVWVSIVITLAWRVLNWVWLRPKKLERCLREQGLTGNSYRLLFGDTKDLSKMLEQTQSKPIKLSTSHDIAPRVTPFFHRTVNSNGKNSFVWMGPIPRVHIMNPEDLKDAFNRHDDFHKTVKNPIMKSPPPGIVGIEGEQWAKHRKIINPAFHLEKLKGMVPIFYQSCSEMINKWESLVSKESSCELDVWPYLENFTSDVISRAAFGSSYEEGRKIFQLLREEAKVYSVALRSVYIPGWRFLPTKQNKKTKEIHNEIKGLLKGIINKREEAMKAGEATKDDLLGILMESNFREIQEHGNNKNAGMSIEDVIGECKLFYFAGQETTSVLLVWTMILLSQNQDWQARAREEVLKVFGSNIPTYEELSHLKVVTMILLEVLRLYPSVVALPRTTHKKTQLGKLSLPAGVEVSLPILLVHHDKELWGEDANEFKPERFSEGVSKATKNKFTYLPFGGGPRICIGQNFAMVEAKLALALILQHFAFELSPSYAHAPSAVITLQPQFGAHIILHKR

SEQ ID NO: 101 - protein, 517 aa, Prunus mume
ASWVAVLSVVWVSMVIAWAWRVLNWVWLRPKKLEKCLREQGLAGNSYRLLFGDTKDLSKMLEQTQSKPIKLSTSHDIAPHVTPFFHQTVNSYGKNSFVWMGPIPRVHIMNPEDLKDTFNRHDDFHKVVKNPIMKSLPQGIVGIEGEQWAKHRKIINPAFHLEKLKGMVPIFYRSCSEMINKWESLVSKESSCELDVWPYLENFTSDVISRAAFGSSYEEGRKIFQLLREEAKIYTVAMRSVYIPGWRFLPTKQNKKAKEIHNEIKGLLKGIINKREEAMKAGEATKDDLLGILMESNFREIQEHGNNKNAGMSIEDVIGECKLFYFAGQETTSVLLVWTMVLLSQNQDWQARAREEVLQVFGSNIPTYEELSQLKVVTMILLEVLRLYPSVVALPRTTHKKTQLGKLSLPAGVEVSLPILLVHHDKELWGEDANEFKPERFSEGVSKATKNQFTYFPFGGGPRICIGQNFAMMEAKLALSLILRHFALELSPLYAHAPSVTITLQPQYGAHIILHKR

SEQ ID NO: 102 - protein, 521 aa, Prunus mume
MEASRPSCVALSVVLVSIVIAWAWRVLNWVWLRPNKLERCLREQGLTGNSYRLLFGDTKEISMMVEQAQSKPIKLSTTHDIAPRVIPFSHQIVYTYGRNSFVWMGPTPRVTIMNPEDLKDAFNKSDEFQRAISNPIVKSISQGLSSLEGEKWAKHRKIINPAFHLEKLKGMLPTFYQSCSEMINKWESLVFKEGSREMDVWPYLENLTSDVISRAAFGSSYEEGRKIFQLLREEAKFYTIAARSVYIPGWRFLPTKQNKRMKEIHKEVRGLLKGIINKREDAIKAGEAAKGNLLGILMESNFREIQEHGNNKNAGMSIEDVIGECKLFYFAGQETTSVLLVWTLVLLSQNQDWQARAREEVLQVFGTNIPTYDQLSHLKVVTMILLEVLRLYPAVVELPRTTYKKTQLGKFLLPAGVEVSLHIMLAHHDKELWGEDAKEFKPERFSEGVSKATKNQFTYFPFGAGPRICIGQNFAMLEAKLALSLILQHFTFELSPSYAHAPSVTITLHPQFGAHFILHKR

SEQ ID NO: 103 - protein, 514 aa, Prunus mume
CVALSVVLVSIVIAWAWRVLNWVWLRPNKLERCLREQGLTGNSYRLLFGDTKEISMMVEQAQSKPIKLSTTHDIAPRVIPFSHQIVYTYGRNSFVWMGPTPRVTIMNPEDLKDAFNKSDEFQRAISNPIVKSISQGLSSLEGEKWAKHRKIINPAFHLEKLKGMLPTFYQSCSEMINKWESLVFKEGSREMDVWPYLENLTSDVISRAAFGSSYEEGRKIFQLLREEAKFYTIAARSVYIPGWRFLPTKQNKRMKEIHKEVRGLLKGIINKREDAIKAGEAAKGNLLGILMESNFREIQEHGNNKNAGMSIEDVIGECKLFYFAGQETTSVLLVWTLVLLSQNQDWQARAREEVLQVFGTNIPTYDQLSHLKVVTMILLEVLRLYPAVVELPRTTYKKTQLGKFLLPAGVEVSLHIMLAHHDKELWGEDAKEFKPERFSEGVSKATKNQFTYFPFGAGPRICIGQNFAMLEAKLALSLILQHFTFELSPSYAHAPSVTITLHPQFGAHFILHKR

SEQ ID NO: 104 - protein, 418 aa, Prunus persica
MGPIPRVHIMNPEDLKDTFNRHDDFHKVVKNPIMKSLPQGIVGIEGDQWAKHRKIINPAFHLEKLKGMVPIFYQSCSEMINIWKSLVSKESSCELDVWPYLENFTSDVISRAAFGSSYEEGRKIFQLLREEAKVYTVAVRSVYIPGWRFLPTKQNKKTKEIHNEIKGLLKGIINKREEAMKAGEATKDDLLGILMESNFREIQEHGNNKNAGMSIEDVIGECKLFYFAGQETTSVLLVWTMVLLSQNQDWQARAREEVLQVFGSNIPTYEELSHLKVVTMILLEVLRLYPSVVALPRTTHKKTQLGKLSLPAGVEVSLPILLVHHDKELWGEDANEFKPERFSEGVSKATKNQFTYFPFGGGPRICIGQNFAMMEAKLALSLILQHFTFELSPQYSHAPSVTITLQPQYGAHLILHKR

SEQ ID NO: 105 - DNA, 1578 bp, Artificial Sequence
  Codon-optimized KAH
atgggtttgttcccattagaggattcctacgcgctggtctttgaaggactagcaataacactggctttgtactatctactgtctttcatctacaaaacatctaaaaagacatgtacacctcctaaagcatctggtgaaatcattccaattacaggaatcatattgaatctgctatctggctcaagtggtctacctattatcttagcacttgcctctttagcagacagatgtggtcctattttcaccattaggctgggtattaggagagtgctagtagtatcaaattgggaaatcgctaaggagattttcactacccacgatttgatagtttctaatagaccaaaatacttagccgctaagattcttggtttcaattatgtttcattctctttcgctccatacggcccatattgggtcggaatcagaaagattattgctacaaaactaatgtcttcttccagacttcagaagttgcaatttgtaagagtttttgaactagaaaactctatgaaatctatcagagaatcatggaaggagaaaaaggatgaagagggaaaggtattagttgagatgaaaaagtggttctgggaactgaatatgaacatagtgttaaggacagttgctggtaaacaatacactggtacagttgatgatgccgatgcaaagcgtatctccgagttattcagagaatggtttcactacactggcagatttgtcgttggagacgcttttccttttctaggttggttggacctgggcggatacaaaaagacaatggaattagttgctagtagattggactcaatggtcagtaaatggttagatgagcatcgtaaaaagcaagctaacgatgacaaaaaggaggatatggatttcatggatatcatgatctccatgacagaagcaaattcaccacttgaaggatacggcactgatactattatcaagaccacatgtatgactttgattgtttcaggagttgatacaacctcaatcgtacttacttgggccttatcacttttgttaaacaacagagatactttgaaaaaggcacaagaggaattagatatgtgcgtaggtaaaggaagacaagtcaacgagtctgatcttgttaacttgatatacttggaagcagtgcttaaagaggctttaagactttacccagcagcgttcttaggcggaccaagagcattcttggaagattgtactgttgctggttatagaattccaaagggcacctgcttgttgattaacatgtggaaactgcatagagatccaaacatttggagtgatccttgcgaattcaagccagaaagatttttgacacctaatcaaaaggatgttgatgtgatcggtatggatttcgaattgataccatttggtgccggcagaagatattgtccaggtactagattggctttacagatgttgcatatcgtattagcgacattgctgcaaaacttcgaaatgtcaacaccaaacgatgcgccagtcgatatgactgcttctgttggcatgacaaatgccaaagcatcacctttagaagtcttgctatcacctcgtgttaaatggtcctaa

SEQ ID NO: 106 - protein, 522 aa, Stevia rebaudiana
MGLFPLEDSYALVFEGLAITLALYYLLSFIYKTSKKTCTPPKASGEHPITGHLNLLSGSSGLPHLALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 107 - DNA, 1431 bp, Artificial Sequence
  Codon-optimized KAH
atgatacaagttttaactccaattctactcttcctcatcttcttcgttttctggaaagtctacaaacatcaaaagactaaaatcaatctaccaccaggttccttcggctggccatttttgggtgaaaccttagccttacttagagcaggctgggattctgagccagaaagattcgtaagagagcgtatcaaaaagcatggatctccacttgttttcaagacatcactatttggagacagattcgctgttctttgcggtccagctggtaataagtttttgttctgcaacgaaaacaaattagtggcatcttggtggccagtccctgtaaggaagttgttcggtaaaagtttactcacaataagaggagatgaagcaaaatggatgagaaaaatgctattgtcttacttgggtccagatgcatttgccacacattatgccgttactatggatgttgtaacacgtagacatattgatgtccattggaggggcaaggaggaagttaatgtatttcaaacagttaagttgtacgcattcgaattagcttgtagattattcatgaacctagatgacccaaaccacatcgcgaaactcggtagtcttttcaacattttcctcaaagggatcatcgagcttcctatagacgttcctggaactagattttactccagtaaaaaggccgcagctgccattagaattgaattgaaaaagctcattaaagctagaaaactcgaattgaaggagggtaaggcgtcttcttcacaggacttgctttctcatctattaacatcacctgatgagaatgggatgttcttgacagaagaggaaatagtcgataacattctacttttgttattcgctggtcacgatacctctgcactatcaataacacttttgatgaaaaccttaggtgaacacagtgatgtgtacgacaaggttttgaaggaacaattagaaatttccaaaacaaaggaggcttgggaatcactaaagtgggaagatatccagaagatgaagtactcatggtcagtaatctgtgaagtcatgagattgaatcctcctgtcatagggacatacagagaggcgttggttgatatcgactatgctggttacactatcccaaaaggatggaagttgcattggtcagctgtttctactcaaagagacgaagccaatttcgaagatgtaactagattcgatccatccagatttgaaggggcaggccctactccattcacatttgtgcctttcggtggaggtcctagaatgtgtttaggcaaagagtttgccaggttagaagtgttagcatttctccacaacattgttaccaactttaagtgggatcttctaatccctgatgagaagatcgaatatgatccaatggctactccagctaagggcttgccaattagacttcatccacaccaagtctaa

SEQ ID NO: 108 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 109 - DNA, 1578 bp, Artificial Sequence
  Codon-optimized KAH
atggagtctttagtggttcatacagtaaatgctatctggtgtattgtaatcgtcgggattttctcagttggttatcacgtttacggtagagctgtggtcgaacaatggagaatgagaagatcactgaagctacaaggtgttaaaggcccaccaccatccatcttcaatggtaacgtctcagaaatgcaacgtatccaatccgaagctaaacactgctctggcgataacattatctcacatgattattcttcttcattattcccacacttcgatcactggagaaaacagtacggcagaatctacacatactctactggattaaagcaacacttgtacatcaatcatccagaaatggtgaaggagctatctcagactaacacattgaacttgggtagaatcacccatataaccaaaagattgaatcctatcttaggtaacggaatcataacctctaatggtcctcattgggcccatcagcgtagaattatcgcctacgagtttactcatgataagatcaagggtatggttggtttgatggttgagtctgctatgcctatgttgaataagtgggaggagatggtaaagagaggcggagaaatgggatgcgacataagagttgatgaggacttgaaagatgtttcagcagatgtgattgcaaaagcctgtttcggatcctcattttctaaaggtaaggctattttctctatgataagagatttgcttacagctatcacaaagagaagtgttctattcagattcaacggattcactgatatggtctttgggagtaaaaagcatggtgacgttgatatagacgctttagaaatggaattggaatcatccatttgggaaactgtcaaggaacgtgaaatagaatgtaaagatactcacaaaaaggatctgatgcaattgattttggaaggggcaatgcgttcatgtgacggtaacctttgggataaatcagcatatagaagatttgttgtagataattgtaaatctatctacttcgcagggcatgatagtacagctgtctcagtgtcatggtgtttgatgttactggccctaaacccatcatggcaagttaagatccgtgatgaaattctgtcttcttgcaaaaatggtattccagatgccgaaagtatcccaaaccttaaaacagtgactatggttattcaagagacaatgagattataccctccagcaccaatcgtcgggagagaagcctctaaagatatcagattgggcgatctagttgttcctaaaggcgtctgtatatggacactaataccagctttacacagagatcctgagatttggggaccagatgcaaacgatttcaaaccagaaagattttctgaaggaatttcaaaggcttgtaagtatcctcaaagttacattccatttggtctgggtcctagaacatgcgttggtaaaaactttggcatgatggaagtaaaggttcttgtttccctgattgtctccaagttctctttcactctatctcctacctaccaacatagtcctagtcacaaacttttagtagaaccacaacatggggtggtaattagagtggtttaa

SEQ ID NO: 110 - protein, 525 aa, Arabidopsis thaliana
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 111 - DNA, 1590 bp, Artificial Sequence
  Codon-optimized KAH
atgtacttcctactacaatacctcaacatcacaaccgttggtgtctttgccacattgtttctctcttattgtttacttctctggagaagtagagcgggtaacaaaaagattgccccagaagctgccgctgcatggcctattatcggccacctccacttacttgcaggtggatcccatcaactaccacatattacattgggtaacatggcagataagtacggtcctgtattcacaatcagaataggcttgcatagagctgtagttgtctcatcttgggaaatggcaaaggaatgttcaacagctaatgatcaagtgtcttcttcaagacctgaactattagcttctaagttgttgggttataactacgccatgtttggtttttcaccatacggttcatactggagagaaatgagaaagatcatctctctcgaattactatctaattccagattggaactattgaaagatgttagagcctcagaagttgtcacatctattaaggaactatacaaattgtgggcggaaaagaagaatgagtcaggattggtttctgtcgagatgaaacaatggttcggagatttgactttaaacgtgatcttgagaatggtggctggtaaaagatacttctccgcgagtgacgcttcagaaaacaaacaggcccagcgttgtagaagagtcttcagagaattcttccatctctccggcttgtttgtggttgctgatgctataccttttcttggatggctcgattggggaagacacgagaagaccttgaaaaagaccgccatagaaatggattccatcgcccaggagtggcttgaggaacatagacgtagaaaagattctggagatgataattctacccaagatttcatggacgttatgcaatctgtgctagatggcaaaaatctaggcggatacgatgctgatacgattaacaaggctacatgcttaactcttatatcaggtggcagtgatactactgtagtttctttgacatgggctcttagtcttgtgttaaacaatagagatactttgaaaaaggcacaggaagagttagacatccaagtcggtaaggaaagattggttaacgagcaagacatcagtaagttagtttacttgcaagcaatagtaaaagagacactcagactttatccaccaggtcctttgggtggtttgagacaattcactgaagattgtacactaggtggctatcacgtttcaaaaggaactagattaatcatgaacttatccaagattcaaaaagatccacgtatttggtctgatcctactgaattccaaccagagagattccttacgactcataaagatgtcgatccacgtggtaaacactttgaattcattccattcggtgcaggaagacgtgcatgtcctggtatcacattcggattacaagtactacatctaacattggcatctttcttgcatgcgtttgaattttcaacaccatcaaatgagcaggttaacatgagagaatcattaggtcttacgaatatgaaatctaccccattagaagttttgatttctccaagactatcccttaattgcttcaaccttatgaaaatttga

SEQ ID NO: 112 - protein, 526 aa, Vitis vinifera
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSSCSLYN

SEQ ID NO: 113 - DNA, 1440 bp, Artificial Sequence
  Codon-optimized KAH
atggaacctaacttttacttgtcattactattgttgttcgtgaccttcatttctttaagtctgtttttcatcttttacaaacaaaagtccccattgaatttgccaccagggaaaatgggttaccctatcataggtgaaagtttagaattcctatccacaggctggaagggacatcctgaaaagttcatatttgatagaatgcgtaagtacagtagtgagttattcaagacttctattgtaggcgaatccacagttgtttgctgtggggcagctagtaacaaattcctattctctaacgaaaacaaactggtaactgcctggtggccagattctgttaacaaaatcttcccaacaacttcactggattctaatttgaaggaggaatctataaagatgagaaagttgctgccacagttcttcaaaccagaagcacttcaaagatacgtcggcgttatggatgtaatcgcacaaagacattttgtcactcactgggacaacaaaaatgagatcacagtttatccacttgctaaaagatacactttcttgcttgcgtgtagactgttcatgtctgttgaggatgaaaatcatgtggcgaaattctcagacccattccaactaatcgctgcaggcatcatttcacttcctatcgatcttcctggtactccattcaacaaggccataaaggcttcaaatttcattagaaaagagctgataaagattatcaaacaaagacgtgttgatctggcagagggtacagcatctccaacccaggatatcttgtcacatatgctattaacatctgatgaaaacggtaaatctatgaacgagttgaacattgccgacaagattcttggactattgataggaggccacgatacagcttcagtagcttgcacatttctagtgaagtacttaggagaattaccacatatctacgataaagtctaccaagagcaaatggaaattgccaagtccaaacctgctggggaattgttgaattgggatgacttgaaaaagatgaagtattcatggaatgtggcatgtgaggtaatgagattgtcaccacctttacaaggtggttttagagaggctataactgactttatgtttaacggtttctctattccaaaagggtggaagttatactggtccgccaactctacacacaaaaatgcagaatgtttcccaatgcctgagaaattcgatcctaccagatttgaaggtaatggtccagcgccttatacatttgtaccattcggtggaggccctagaatgtgtcctggaaaggaatacgctagattagaaatcttggttttcatgcataatctggtcaaacgttttaagtgggaaaaggttattccagacgaaaagattattgtcgatccattcccaatcccagctaaagatcttccaatccgtttgtatcctcacaaagcttaa

SEQ ID NO: 114 - protein, 479 aa, Medicago truncatula
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 115 - DNA, 1116 bp, Artificial Sequence
  Codon-optimized GGPPS
atggcctctgttactttgggttcctggatcgtcgtccaccaccataaccatcaccatccatcatctatcctaactaaatctcgttcaagatcctgtcctattacactaaccaaaccaatctcttttcgttcaaagagaacagtttcctctagtagttctatcgtgtcctctagtgtcgtcactaaggaagacaatctgagacagtctgaaccttcttcctttgatttcatgtcatatatcattactaaggcagaactagtgaataaggctcttgattcagcagttccattaagagagccattgaaaatccatgaagcaatgagatactctcttctagctggcgggaagagagtcagacctgtactctgcatagcagcgtgcgaattagttggtggcgaggaatcaaccgctatgcctgccgcttgtgctgtagaaatgattcatacaatgtcactgatacacgatgatttgccatgtatggataacgatgatctgagaaggggtaagccaactaaccataaggttttcggcgaagatgttgccgtcttagctggtgatgctttgttatctttcgcgttcgaacatttggcatccgcaacatcaagtgatgttgtgtcaccagtaagagtagttagagcagttggagaactggctaaagctattggaactgagggtttagttgcaggtcaagtcgtcgatatctcttccgaaggtcttgatttgaatgatgtaggtcttgaacatctcgaattcatccatcttcacaagacagctgcacttttagaagccagtgcggttctcggcgcaattgttggcggagggagtgatgacgaaattgagagattgaggaagtttgctagatgtataggattactgttccaagtagtagacgatatactagatgtgacaaagtcttccaaagagttgggaaaaacagctggtaaagatttgattgccgacaaattgacctaccctaagattatggggctagaaaaatcaagagaatttgccgagaaactcaatagagaggcgcgtgatcaactgttgggtttcgattctgataaagttgcaccactcttagccttagccaactacatcgcttacagacaaaactaa

SEQ ID NO: 116 - protein, 371 aa, Arabidopsis thaliana
MASVTLGSWIVVHHHNHHHPSSILTKSRSRSCPITLTKPISFRSKRTVSSSSSIVSSSVVTKEDNLRQSEPSSFDFMSYIITKAELVNKALDSAVPLREPLKIHEAMRYSLLAGGKRVRPVLCIAACELVGGEESTAMPAACAVEMIHTMSLIHDDLPCMDNDDLRRGKPTNHKVFGEDVAVLAGDALLSFAFEHLASATSSDVVSPVRVVRAVGELAKAIGTEGLVAGQVVDISSEGLDLNDVGLEHLEFIHLHKTAALLEASAVLGAIVGGGSDDEIERLRKFARCIGLLFQVVDDILDVTKSSKELGKTAGKDLIADKLTYPKIMGLEKSREFAEKLNREARDQLLGFDSDKVAPLLALANYIAYRQN

SEQ ID NO: 117 - protein, 511 aa, Rubus suavissimus
MATLLEHFQAMPFAIPIALAALSWLFLFYIKVSFFSNKSAQAKLPPVPVVPGLPVIGNLLQLKEKKPYQTFTRWAEEYGPIYSIRTGASTMVVLNTTQVAKEAMVTRYLSISTRKLSNALKILTADKCMVAISDYNDFHKMIKRYILSNVLGPSAQKRHRSNRDTLRANVCSRLHSQVKNSPREAVNFRRVFEWELFGIALKQAFGKDIEKPIYVEELGTTLSRDEIFKVLVLDIMEGAIEVDWRDFFPYLRWIPNTRMETKIQRLYFRRKAVMTALINEQKKRIASGEEINCYIDFLLKEGKTLTMDQISMLLWETVIETADTTMVTTEWAMYEVAKDSKRQDRLYQEIQKVCGSEMVTEEYLSQLPYLNAVFHETLRKHSPAALVPLRYAHEDTQLGGYYIPAGTEIAINIYGCNMDKHQWESPEEWKPERFLDPKFDPMDLYKTMAFGAGKRVCAGSLQAMLIACPTIGRLVQEFEWKLRDGEEENVDTVGLTTHKRYPMHAILKPRS

SEQ ID NO: 118 - protein, 460 aa, Artificial Sequence
  UGT74G1 Var_1
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVEHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 119 - DNA, 1383 bp, Artificial Sequence
  UGT74G1 Var_2
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttgtttctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 120 - protein, 460 aa, Artificial Sequence
  UGT74G1 Var_2
MAEQQKIKKSPHVLLIPFPLQGHINPFIQFGKRLISKGVKTTLVTTIHTLNSTLNHSNTTTTSIEIQAISDGCDEGGFVSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 121 - DNA, 1383 bp, Artificial Sequence
  UGT74G1 Var_3
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaatttcaagatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 122 - protein, 460 aa, Artificial Sequence
  UGT74G1 Var_3
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFQDQTTNAKLLDEILGVGVRVKADENGIVRRGNLASCIKMIMEEERGVIIRKNAVKWKDLAKVAVHEGGSSDNDIVEFVSELIKA

SEQ ID NO: 123 - DNA, 1383 bp, Artificial Sequence
  UGT74G1 Var_4
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtgtgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 124 - protein, 460 aa, Artificial Sequence
  UGT74G1 Var_4
MAEQQKIKKSPHVLLIPFPLQGHINPFIQFGKRLISKGVKTTLVTTIHTLNSTLNHSNTTTTSIEIQAISDGCDEGGFMCAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 125 - DNA, 1383 bp, Artificial Sequence
  UGT74G1 Var_5
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctacccatcatgaatgcatgaattggttggacgacaagccaaaagaatccgttgtttatgttgctttcggttctttggtctgtcatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 126 - protein, 460 aa, Artificial Sequence
  UGT74G1 Var_5
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKATHHECMNWLDDKPKESVVYVAFGSLVCHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 127 - DNA, 1383 bp, Artificial Sequence
  UGT74G1 Var_6
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaacgttgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 128 - protein, 460 aa, Artificial Sequence
  UGT74G1 Var_6
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNVEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 129 - DNA, 1383 bp, Artificial Sequence
  UGT74G1 Var_7
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtcttggggtaaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 130 - protein, 460 aa, Artificial Sequence
  UGT74G1 Var_7
MAEQQKIKKSPHVLLIPFPLQGHINPFIQFGKRLISKGVKTTLVTTIHTLNSTLNHSNTTTTSIEIQAISDGCDEGGFMSWGKSYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 131 - DNA, 2853 bp, Artificial Sequence
  Chim_1
atggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaacagagcctcctccaccaaactagtaaaaatggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 132 - protein, 950 aa, Artificial Sequence
  Chim_1
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARNRASSTKLVKMAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 133 - DNA, 2874 bp, Artificial Sequence
  Chim_2
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggccagagcctcctccaccaaactagtaaaaatggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaacgtcgacctcgagtcatgtaattag

SEQ ID NO: 134 - protein, 957 aa, Artificial Sequence
  Chim_2
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKARASSTKLVKMDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARNVDLESCN

SEQ ID NO: 135 - DNA, 2859 bp, Artificial Sequence
  Chim_3
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggccaaactagtaaaaatggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaacgtcgacctcgagtcatgtaattag

SEQ ID NO: 136 - protein, 952 aa, Artificial Sequence
  Chim_3
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKAKLVKMDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARNVDLESCN

SEQ ID NO: 137 - DNA, 2871 bp, Artificial Sequence
  Chim_4
atggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaacggtggaggaggctctggtggaggcggtagcggaggcggagggtcgatggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 138 - protein, 956 aa, Artificial Sequence
  Chim_4
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARNGGGGSGGGGSGGGGSMAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 139 - DNA, 2841 bp, Artificial Sequence
  Chim_5
atggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaacggtggaggaggctctatggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 140 - protein, 946 aa, Artificial Sequence
  Chim_5
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARNGGGGSMAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 141 - DNA, 2826 bp, Artificial Sequence
  Chim_6
atggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaacatggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 142 - protein, 941 aa, Artificial Sequence
  Chim_6
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARNMAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 143 - DNA, 2871 bp, Artificial Sequence
  Chim_7
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggccggtggaggaggctctggtggaggcggtagcggaggcggagggtcgatggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaactga

SEQ ID NO: 144 - protein, 956 aa, Artificial Sequence
  Chim_7
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKAGGGGSGGGGSGGGGSMDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 145 - DNA, 2841 bp, Artificial Sequence
  Chim_8
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggccggtggaggaggctctatggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaactga

SEQ ID NO: 146 - protein, 946 aa, Artificial Sequence
  Chim_8
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKAGGGGSMDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 147 - DNA, 2826 bp, Artificial Sequence
  Chim_9
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggccatggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaactga

SEQ ID NO: 148 - protein, 941 aa, Artificial Sequence
  Chim_9
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKAMDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 149 - DNA, 1443 bp, Artificial Sequence
  Codon-optimized UGT85C2
atggatgctatggctaccaccgaaaaaaagccacatgttattttcattccattcccagctcaatcccatattaaggctatgttgaagttggcccaattattgcatcacaagggtttacaaatcaccttcgttaacaccgacttcatccacaatcaattcttggaatcttctggtccacattgcttggatggtgctccaggttttagatttgaaactattccagatggtgtttcccattctccagaagcttctattccaattagagaatccttgttgagatccatcgaaactaatttcttggacagattcatcgacttggttactaagttgccagatccaccaacctgtattatttctgatggtttcttgtccgttttcaccattgatgctgctaagaaattgggtatcccagttatgatgtactggactttggctgcttgtggttttatgggtttctaccatatccattccttgatcgaaaagggttttgctccattgaaagatgcctcttacttgactaacggttacttggataccgttattgattgggttccaggtatggaaggtatcagattgaaggattttccattggattggtccactgatttgaacgataaggttttgatgttcactaccgaagctccacaaagatctcataaggtttcccatcatatcttccacaccttcgatgaattggaaccatccattattaagaccttgtccttgagatacaaccacatctataccattggtccattgcaattattattggaccaaatcccagaagaaaagaagcaaactggtattacttccttgcacggttactcattggtcaaagaagaaccagaatgcttccaatggttgcaatctaaagaacctaactccgttgtctacgttaactttggttctactaccgttatgtccttggaagatatgactgaatttggttggggtttggctaactctaaccattacttcttgtggatcatcagatccaacttggttattggtgaaaacgctgttttgccaccagaattggaagaacatatcaagaagagaggtttcattgcttcttggtgttcccaagaaaaggttttgaaacatccatctgtcggtggtttcttgactcattgtggttggggttctaccattgaatctttgtctgctggtgttccaatgatttgttggccatattcttgggatcaattgaccaactgcagatacatctgcaaagaatgggaagtcggtttggaaatgggtacaaaagtcaaaagagatgaagtcaagagattggtccaagaattgatgggtgaaggtggtcataagatgagaaacaaagccaaggactggaaagaaaaggctagaattgctattgctccaaacggttcttcctctttgaacattgacaagatggtcaaagaaatcaccgttttggccagaaac

SEQ ID NO: 150 - protein, 9 aa, Artificial Sequence
  linker
RASSTKLVK

SEQ ID NO: 151 - protein, 14 aa, Artificial Sequence
  linker
EGKSSGSGSESKST

SEQ ID NO: 152 - protein, 191 aa, Escherichia coli
MKAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKK

SEQ ID NO: 153 - protein, 367 aa, Escherichia coli
MKTEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQT

SEQ ID NO: 154 - protein, 495 aa, Escherichia coli [sequence omitted]

SEQ ID NO: 155 - protein, 98 aa, Saccharomyces cerevisiae
MSDSEVNQEAKPEVKPEVKPETHINLKVSDGSSEIFFKIKKTTPLRRLMEAFAKRQGKEMDSLTFLYDGIEIQADQTPEDLDMEDNDIIEAHREQIGG

SEQ ID NO: 156 - DNA, 573 bp, Escherichia coli
atgaaagcgcaatatgaagatggaaagcagtatacgaccttagaaaaaccagtcgctggagctccgcaagtcttggaattctttagttttttttgtccgcattgttaccagtttgaggaagtcttgcatatatccgacaacgtcaaaaagaagttgccagaaggcgttaaaatgacgaaatatcacgttaactttatgggaggtgacttgggaaaagatcttactcaagcctgggccgttgcaatggcattgggagttgaagataaagttacagtgcccttgtttgaaggagttcaaaagacccagactataaggtcagcctccgacattagagacgtctttatcaatgctgggattaagggcgaagagtatgatgccgcgtggaactcctttgttgtcaagagtttagtcgcacaacaagaaaaggctgctgcagacgttcagttaaggggtgtgccagccatgttcgttaatggtaagtatcagttaaatccacaggggatggatacatcaaacatggatgtgttcgtgcaacagtacgcagacactgttaaatatttgtcagagaagaaa

SEQ ID NO: 157 - DNA, 1101 bp, Escherichia coli
atgaaaacagaagaagggaaattggttatatggataaacggtgataagggctataacggattagccgaggtaggtaagaagtttgaaaaagatactggtataaaagttactgttgaacatccggacaaactggaagaaaaatttcctcaagttgctgcaactggcgatggtccagatataatcttctgggcacatgacagattcggcggttacgcacagtccggattgctggctgagatcacccctgacaaggcgttccaagataagctatacccttttacatgggacgcagtgagatacaatggaaaattgattgcttacccaattgcagttgaggcactgtctctgatttacaataaggacttgctaccaaaccctccaaaaacctgggaagaaatcccagccctggacaaagaactaaaagctaaaggaaaatccgccttgatgtttaacttgcaagagccttatttcacatggccgctaattgctgcagatggcggttatgcttttaaatatgaaaacggtaagtatgacatcaaagatgttggagtcgacaatgcaggtgctaaggccggcttaactttcttagtggacttaatcaagaataagcatatgaatgcagacactgattacagcatagcggaggctgctttcaacaaaggtgaaacagctatgacaataaatggcccttgggcctggtctaatatcgacacgtctaaagttaattatggggtaacagtacttccaacgtttaaaggccagccatcaaagccctttgtaggtgtcctgagtgccggtattaacgcagccagcccgaacaaagagttagcgaaagaattcttagaaaattatttactgaccgatgagggtcttgaagcagtgaacaaggataaacctttgggtgcagtcgctttgaagagttacgaagaagaactggctaaggaccccagaattgcagccactatggaaaatgcccaaaagggagaaattatgccaaatatacctcaaatgtcagccttctggtatgcggttaggactgccgttataaacgctgctagtggaaggcagacggtggatgaagcacttaaagatgcgcagaca

SEQ ID NO: 158 - DNA, 1485 bp, Escherichia coli
atgaataaggagattctagcagtcgttgaagcagtaagtaacgaaaaagcattgcctagggagaaaatcttcgaagccctagaaagcgctttggccacagccacgaaaaagaagtacgagcaagaaattgacgttagagttcagatcgacaggaaatcaggtgatttcgatacatttaggagatggttagtagtagatgaggttacacagcctactaaggagattacattagaggcggccagatacgaagacgaatctttgaacttaggggactatgttgaggatcaaattgaatcagttacttttgatagaattacaactcaaacagccaaacaagtcatagttcaaaaagtgagggaagccgaaagagcaatggtggtcgaccaatttcgtgagcacgaaggagagatcataacaggtgtcgttaaaaaggttaatagagataatatttctttggatcttgggaataatgccgaagctgttatcctgagggaagatatgttgccgagggaaaatttcagacctggagatcgtgtcagaggtgttttgtattctgtacgtccagaggcaagaggagctcaattatttgttactcgttctaaaccggagatgcttattgaactatttaggattgaggtgcctgaaattggagaagaagttattgagatcaaagccgctgcacgtgatccaggatcaagagcgaagattgctgttaaaacaaatgataaacgtatcgatcccgtgggtgcgtgtgttggtatgaggggtgctagagtccaggctgtaagcaccgaactgggaggcgagaggattgacattgtcttgtgggacgataatcctgcccagtttgtaataaacgcaatggctcctgctgatgtggcctctatagtcgtggatgaggacaaacataccatggatatagcagtagaagctggtaatttagcccaagcaattggaagaaacggtcaaaacgtccgtttagcttcccagttgtctggttgggaactgaacgtgatgacggttgatgatttacaagctaagcaccaagcagaggctcatgcagcgattgataccttcactaaatatctagatatagacgaggattttgcaactgtgcttgttgaagaaggcttttctacgttagaagaactagcttacgtcccaatgaaggaattattagaaatcgagggtttggatgaacctacagtggaggctttgagagaaagggccaagaatgccctagcaactatagctcaagcacaagaggaatcactgggagataataagcctgcagacgatttgctgaacctagaaggtgtagatagggacttggcttttaagctagcagccagaggcgtgtgtacactagaggatttggctgaacaaggaatagatgacctagctgacattgaagggttgacagatgaaaaagctggggccttaataatggccgctaggaatatttgctggttcggggatgaggca

SEQ ID NO: 159 - DNA, 294 bp, Saccharomyces cerevisiae
atgagtgactctgaagtgaatcaagaggctaaaccagaagtaaagcccgaagtaaagccagagacccacatcaacttgaaggtttcagacgggtcttcagagatattctttaaaatcaaaaagacaacgcccttgagaaggctaatggaagcgtttgccaagagacaaggaaaagaaatggatagtttaactttcttgtacgatgggattgagattcaagcagatcaaactccggaagatttggacatggaagataatgatatcattgaagctcatagagaacaaatcggaggt

SEQ ID NO: 160 - DNA, 1383 bp, Artificial Sequence
  UGT74G1 Var_8
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtcttggggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 161 - protein, 460 aa, Artificial Sequence
  UGT74G1 Var_8
MAEQQKIKKSPHVLLIPFPLQGHINPFIQFGKRLISKGVKTTLVTTIHTLNSTLNHSNTTTTSIEIQAISDGCDEGGFMSWGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 162 - DNA, 1383 bp, Artificial Sequence
  UGT74G1 Var_9
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaacactgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 163 - protein, 460 aa, Artificial Sequence
  UGT74G1 Var_9
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNTEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 164 - DNA, 1383 bp, Artificial Sequence
  UGT74G1 Var_10
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaatcatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 165 - protein, 460 aa, Artificial Sequence
  UGT74G1 Var_10
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVNHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 166 - DNA, 1383 bp, Artificial Sequence
  UGT74G1 Var_11
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttgaatctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 167 - protein, 460 aa, Artificial Sequence
  UGT74G1 Var_11
MAEQQKIKKSPHVLLIPFPLQGHINPFIQFGKRLISKGVKTTLVTTIHTLNSTLNHSNTTTTSIEIQAISDGCDEGGFESAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 168 - DNA, 1383 bp, Artificial Sequence
  UGT74G1 Var_12
atggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcactcatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 169 - protein, 460 aa, Artificial Sequence
  UGT74G1 Var_12
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVTHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 170 - DNA, 420 bp, Artificial Sequence
  pTEF1 promoter nucleotide sequence
gcacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaa

SEQ ID NO: 171 - DNA, 195 bp, Artificial Sequence
  tADH1 terminator nucleotide sequence
gtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctc

SEQ ID NO: 172 - DNA, 42 bp, Artificial Sequence
  linker nucleotide sequence
gaaggtaaatcctctggctcaggtagcgagtctaaaagtacc

SEQ ID NO: 173 - DNA, 1998 bp, Artificial Sequence
  Chim_10
atgaaagcgcaatatgaagatggaaagcagtatacgaccttagaaaaaccagtcgctggagctccgcaagtcttggaattctttagttttttttgtccgcattgttaccagtttgaggaagtcttgcatatatccgacaacgtcaaaaagaagttgccagaaggcgttaaaatgacgaaatatcacgttaactttatgggaggtgacttgggaaaagatcttactcaagcctgggccgttgcaatggcattgggagttgaagataaagttacagtgcccttgtttgaaggagttcaaaagacccagactataaggtcagcctccgacattagagacgtctttatcaatgctgggattaagggcgaagagtatgatgccgcgtggaactcctttgttgtcaagagtttagtcgcacaacaagaaaaggctgctgcagacgttcagttaaggggtgtgccagccatgttcgttaatggtaagtatcagttaaatccacaggggatggatacatcaaacatggatgtgttcgtgcaacagtacgcagacactgttaaatatttgtcagagaagaaagaaggtaaatcctctggctcaggtagcgagtctaaaagtaccatggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 174 - protein, 665 aa, Artificial Sequence
  Chim_10
MKAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKKEGKSSGSGSESKSTMAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 175 - DNA, 2526 bp, Artificial Sequence
  Chim_11
atgaaaacagaagaagggaaattggttatatggataaacggtgataagggctataacggattagccgaggtaggtaagaagtttgaaaaagatactggtataaaagttactgttgaacatccggacaaactggaagaaaaatttcctcaagttgctgcaactggcgatggtccagatataatcttctgggcacatgacagattcggcggttacgcacagtccggattgctggctgagatcacccctgacaaggcgttccaagataagctatacccttttacatgggacgcagtgagatacaatggaaaattgattgcttacccaattgcagttgaggcactgtctctgatttacaataaggacttgctaccaaaccctccaaaaacctgggaagaaatcccagccctggacaaagaactaaaagctaaaggaaaatccgccttgatgtttaacttgcaagagccttatttcacatggccgctaattgctgcagatggcggttatgcttttaaatatgaaaacggtaagtatgacatcaaagatgttggagtcgacaatgcaggtgctaaggccggcttaactttcttagtggacttaatcaagaataagcatatgaatgcagacactgattacagcatagcggaggctgctttcaacaaaggtgaaacagctatgacaataaatggcccttgggcctggtctaatatcgacacgtctaaagttaattatggggtaacagtacttccaacgtttaaaggccagccatcaaagccctttgtaggtgtcctgagtgccggtattaacgcagccagcccgaacaaagagttagcgaaagaattcttagaaaattatttactgaccgatgagggtcttgaagcagtgaacaaggataaacctttgggtgcagtcgctttgaagagttacgaagaagaactggctaaggaccccagaattgcagccactatggaaaatgcccaaaagggagaaattatgccaaatatacctcaaatgtcagccttctggtatgcggttaggactgccgttataaacgctgctagtggaaggcagacggtggatgaagcacttaaagatgcgcagacagaaggtaaatcctctggctcaggtagcgagtctaaaagtaccatggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 176 - protein, 841 aa, Artificial Sequence
  Chim_11
MKTEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTEGKSSGSGSESKSTMAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 177 - DNA, 2910 bp, Artificial Sequence
  Chim_12
atgaataaggagattctagcagtcgttgaagcagtaagtaacgaaaaagcattgcctagggagaaaatcttcgaagccctagaaagcgctttggccacagccacgaaaaagaagtacgagcaagaaattgacgttagagttcagatcgacaggaaatcaggtgatttcgatacatttaggagatggttagtagtagatgaggttacacagcctactaaggagattacattagaggcggccagatacgaagacgaatctttgaacttaggggactatgttgaggatcaaattgaatcagttacttttgatagaattacaactcaaacagccaaacaagtcatagttcaaaaagtgagggaagccgaaagagcaatggtggtcgaccaatttcgtgagcacgaaggagagatcataacaggtgtcgttaaaaaggttaatagagataatatttctttggatcttgggaataatgccgaagctgttatcctgagggaagatatgttgccgagggaaaatttcagacctggagatcgtgtcagaggtgttttgtattctgtacgtccagaggcaagaggagctcaattatttgttactcgttctaaaccggagatgcttattgaactatttaggattgaggtgcctgaaattggagaagaagttattgagatcaaagccgctgcacgtgatccaggatcaagagcgaagattgctgttaaaacaaatgataaacgtatcgatcccgtgggtgcgtgtgttggtatgaggggtgctagagtccaggctgtaagcaccgaactgggaggcgagaggattgacattgtcttgtgggacgataatcctgcccagtttgtaataaacgcaatggctcctgctgatgtggcctctatagtcgtggatgaggacaaacataccatggatatagcagtagaagctggtaatttagcccaagcaattggaagaaacggtcaaaacgtccgtttagcttcccagttgtctggttgggaactgaacgtgatgacggttgatgatttacaagctaagcaccaagcagaggctcatgcagcgattgataccttcactaaatatctagatatagacgaggattttgcaactgtgcttgttgaagaaggcttttctacgttagaagaactagcttacgtcccaatgaaggaattattagaaatcgagggtttggatgaacctacagtggaggctttgagagaaagggccaagaatgccctagcaactatagctcaagcacaagaggaatcactgggagataataagcctgcagacgatttgctgaacctagaaggtgtagatagggacttggcttttaagctagcagccagaggcgtgtgtacactagaggatttggctgaacaaggaatagatgacctagctgacattgaagggttgacagatgaaaaagctggggccttaataatggccgctaggaatatttgctggttcggggatgaggcagaaggtaaatcctctggctcaggtagcgagtctaaaagtaccatggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 178 - protein, 969 aa, Artificial Sequence
  Chim_12
MNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEAEGKSSGSGSESKSTMAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 179 - DNA, 1719 bp, Artificial Sequence
  Chim_13
atgagtgactctgaagtgaatcaagaggctaaaccagaagtaaagcccgaagtaaagccagagacccacatcaacttgaaggtttcagacgggtcttcagagatattctttaaaatcaaaaagacaacgcccttgagaaggctaatggaagcgtttgccaagagacaaggaaaagaaatggatagtttaactttcttgtacgatgggattgagattcaagcagatcaaactccggaagatttggacatggaagataatgatatcattgaagctcatagagaacaaatcggaggtgaaggtaaatcctctggctcaggtagcgagtctaaaagtaccatggctgaacaacaaaagatcaagaagtctccacacgttttgttgattccatttccattgcaaggtcacatcaacccattcattcaattcggtaagagattgatttccaagggtgttaagactactttggttactaccatccataccttgaactctaccttgaaccattctaacactaccaccacctccattgaaattcaagctatttccgatggttgtgatgaaggtggttttatgtctgctggtgaatcttacttggaaacctttaagcaagttggttctaagtccttggccgatttgattaagaagttgcaatctgaaggtactaccattgatgccattatctacgattctatgaccgaatgggttttggatgttgctattgaattcggtattgatggtggttcattcttcactcaagcttgtgttgttaactccttgtactaccatgttcacaagggtttgatctcattgccattgggtgaaactgtttctgttccaggtttcccagttttacaaagatgggaaactccattgatcttgcaaaaccacgaacaaattcaatctccatggtcccaaatgttgtttggtcaattcgccaacattgatcaagctagatgggtttttaccaactccttctacaagttggaagaagaagttatcgaatggaccagaaagatctggaacttgaaagttattggtccaaccttgccatctatgtacttggataagagattggatgacgataaggacaacggtttcaacttgtacaaggctaaccatcatgaatgcatgaattggttggacgacaagccaaaagaatccgttgtttatgttgctttcggttctttggtcaaacatggtccagaacaagttgaagaaattaccagagccttgatcgattccgatgttaatttcttgtgggtcatcaagcacaaagaagaaggtaaattgccagaaaacttgtccgaagttatcaaaactggtaagggtttgattgtcgcttggtgtaaacaattggatgttttggctcatgaatccgttggttgtttcgttactcattgtggtttcaactccaccttggaagctatttctttgggtgttccagttgttgctatgccacaattttctgatcaaactaccaacgctaagttgttggacgaaattttgggtgttggtgttagagttaaggctgacgaaaatggtatcgttagaagaggtaacttggcttcttgcatcaagatgatcatggaagaagaaagaggtgtcatcattagaaagaacgctgttaagtggaaggatttggctaaagttgctgttcatgaaggtggtagttccgataatgatatcgttgaattcgtttccgaattgatcaaggcctaa

SEQ ID NO: 180 - protein, 572 aa, Artificial Sequence
  Chim_13
MSDSEVNQEAKPEVKPEVKPETHINLKVSDGSSEIFFKIKKTTPLRRLMEAFAKRQGKEMDSLTFLYDGIEIQADQTPEDLDMEDNDIIEAHREQIGGEGKSSGSGSESKSTMAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 181 - DNA, 462 bp, Saccharomyces cerevisiae
atgtctagtcaaacagaaagaacttttattgcggtaaaaccagatggtgtccagaggggcttagtatctcaaattctatctcgttttgaaaaaaaaggttacaaactagttgctattaaattagttaaagcggatgataaattactagagcaacattacgcagagcatgttggtaaaccatttttcccaaagatggtatcctttatgaagtctggtcccattttggccacggtctgggagggaaaagatgtggttagacaaggaagaactattcttggtgctactaatcctttgggcagtgcaccaggtaccattagaggtgatttcggtattgacctaggcagaaacgtctgtcacggcagtgattctgttgatagcgctgaacgtgaaatcaatttgtggtttaagaaggaagagttagttgattgggaatctaatcaagctaagtggatttatgaatga

SEQ ID NO: 182 - protein, 153 aa, Saccharomyces cerevisiae
MSSQTERTFIAVKPDGVQRGLVSQILSRFEKKGYKLVAIKLVKADDKLLEQHYAEHVGKPFFPKMVSFMKSGPILATVWEGKDVVRQGRTILGATNPLGSAPGTIRGDFGIDLGRNVCHGSDSVDSAEREINLWFKKEELVDWESNQAKWIYE

SEQ ID NO: 183 - DNA, 192 bp, Artificial Sequence
  CYC1 terminator nucleotide sequence
atccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaag

SEQ ID NO: 184 - DNA, 1713 bp, Saccharomyces cerevisiae
atgtcacttctaatagattctgtaccaacagttgcttataaggaccaaaaaccgggtacttcaggtttacgtaagaagaccaaggttttcatggatgagcctcattatactgagaacttcattcaagcaacaatgcaatctatccctaatggctcagagggaaccactttagttgttggaggagatggtcgtttctacaacgatgttatcatgaacaagattgccgcagtaggtgctgcaaacggtgtcagaaagttagtcattggtcaaggcggtttactttcaacaccagctgcttctcatataattagaacatacgaggaaaagtgtaccggtggtggtatcatattaactgcctcacacaacccaggcggtccagagaatgatttaggtatcaagtataatttacctaatggtgggccagctccagagagtgtcactaacgctatctgggaagcgtctaaaaaattaactcactataaaattataaagaacttccccaagttgaatttgaacaagcttggtaaaaaccaaaaatatggcccattgttagtggacataattgatcctgccaaagcatacgttcaatttctgaaggaaatttttgattttgacttaattaaaagcttcttagcgaaacagcgcaaagacaaagggtggaagttgttgtttgactccttaaatggtattacaggaccatatggtaaggctatatttgttgatgaatttggtttaccggcagaggaagttcttcaaaattggcaccctttacctgatttcggcggtttacatcccgatccgaatctaacctatgcacgaactcttgttgacagggttgaccgcgaaaaaattgcctttggagcagcctccgatggtgatggtgataggaatatgatttacggttatggccctgctttcgtttcgccaggtgattctgttgccattattgccgaatatgcacccgaaattccatacttcgccaaacaaggtatttatggcttggcacgttcatttcctacatcctcagccattgatcgtgttgcagcaaaaaagggattaagatgttacgaagttccaaccggctggaaattcttctgtgccttatttgatgctaaaaagctatcaatctgtggtgaagaatccttcggtacaggttccaatcatatcagagaaaaggacggtctatgggccattattgcttggttaaatatcttggctatctaccataggcgtaaccctgaaaaggaagcttcgatcaaaactattcaggacgaattttggaacgagtatggccgtactttcttcacaagatacgattacgaacatatcgaatgcgagcaggccgaaaaagttgtagctcttttgagtgaatttgtatcaaggccaaacgtttgtggctcccacttcccagctgatgagtctttaaccgttatcgattgtggtgatttttcgtatagagatctagatggctccatctctgaaaatcaaggccttttcgtaaagttttcgaatgggactaaatttgttttgaggttatccggcacaggcagttctggtgcaacaataagattatacgtagaaaagtatactgataaaaaggagaactatggccaaacagctgacgtcttcttgaaacccgtcatcaactccattgtaaaattcttaagatttaaagaaattttaggaacagacgaaccaacagtccgcacatag

SEQ ID NO: 185 - protein, 570 aa, Saccharomyces cerevisiae
MSLLIDSVPTVAYKDQKPGTSGLRKKTKVFMDEPHYTENFIQATMQSIPNGSEGTTLVVGGDGRFYNDVIMNKIAAVGAANGVRKLVIGQGGLLSTPAASHIIRTYEEKCTGGGIILTASHNPGGPENDLGIKYNLPNGGPAPESVTNAIWEASKKLTHYKIIKNFPKLNLNKLGKNQKYGPLLVDIIDPAKAYVQFLKEIFDFDLIKSFLAKQRKDKGWKLLFDSLNGITGPYGKAIFVDEFGLPAEEVLQNWHPLPDFGGLHPDPNLTYARTLVDRVDREKIAFGAASDGDGDRNMIYGYGPAFVSPGDSVAIIAEYAPEIPYFAKQGIYGLARSFPTSSAIDRVAAKKGLRCYEVPTGWKFFCALFDAKKLSICGEESFGTGSNHIREKDGLWAIIAWLNILAIYHRRNPEKEASIKTIQDEFWNEYGRTFFTRYDYEHIECEQAEKVVALLSEFVSRPNVCGSHFPADESLTVIDCGDFSYRDLDGSISENQGLFVKFSNGTKFVLRLSGTGSSGATIRLYVEKYTDKKENYGQTADVFLKPVINSIVKFLRFKEILGTDEPTVRT

SEQ ID NO: 186 - DNA, 1710 bp, Saccharomyces cerevisiae
atgtcatttcaaattgaaacggttcccaccaaaccatatgaagaccaaaagcctggtacctctggtttgcgtaagaagacaaaggtgtttaaagacgaacctaactacacagaaaatttcattcaatcgatcatggaagctattccagagggttctaaaggtgccactcttgttgtcggtggtgatgggcgttactacaatgatgtcattcttcataagattgccgctatcggtgctgccaacggtattaaaaagttagttattggccagcatggtcttctgtctacgccagccgcttctcacatcatgagaacctacgaggaaaaatgtactggtggtattatcttaaccgcctcacataatccaggtggtccagaaaatgacatgggtattaagtataacttatccaatgggggtcctgctcctgaatccgtcacaaatgctatttgggagatttccaaaaagcttaccagctataagattatcaaagacttcccagaactagacttgggtacgataggcaagaacaagaaatacggtccattactcgttgacattatcgatattacaaaagattatgtcaacttcttgaaggaaatcttcgatttcgacttaatcaagaaattcatcgataatcaacgttctactaagaattggaagttactgtttgacagtatgaacggtgtaactggaccatacggtaaggctattttcgttgatgaatttggtttaccggcggatgaggttttacaaaactggcatccttctccggattttggtggtatgcatccagatccaaacttaacttatgccagttcgttagtgaaaagagtagatcgtgaaaagattgagtttggtgctgcatccgatggtgatggtgatagaaatatgatttacggttacggcccatctttcgtttctccaggtgactccgtcgcaattattgccgaatatgcagctgaaatcccatatttcgccaagcaaggtatatatggtctggcccgttcattccctacctcaggagccatagaccgtgttgccaaggcccatggtctaaactgttatgaggtcccaactggctggaaatttttctgtgctttgttcgacgctaaaaaattatctatttgtggtgaagaatcgtttggtactggttccaaccacgtaagggaaaaggacggtgtttgggccattatggcgtggttgaacatcttggccatttacaacaagcatcatccggagaacgaagcttctattaagacgatacagaatgaattctgggcaaagtacggccgtactttcttcactcgttatgattttgaaaaagttgaaacagaaaaagctaacaagattgtcgatcaattgagagcatatgttaccaaatcgggtgttgttaattccgccttcccagccgatgagtctcttaaggtcaccgattgtggtgatttttcatacacagatttggacggttctgtttctgaccatcaaggtttatatgtcaagctttccaatggtgcaagattcgttctaagattgtcaggtacaggttcttcaggtgctaccattagattgtacattgaaaaatactgcgatgataaatcacaataccaaaagacagctgaagaatacttgaagccaattattaactcggtcatcaagttcttgaactttaaacaagttttaggaactgaagaaccaacggttcgtacttaa

SEQ ID NO: 187 - protein, 569 aa, Saccharomyces cerevisiae
MSFQIETVPTKPYEDQKPGTSGLRKKTKVFKDEPNYTENFIQSIMEAIPEGSKGATLVVGGDGRYYNDVILHKIAAIGAANGIKKLVIGQHGLLSTPAASHIMRTYEEKCTGGIILTASHNPGGPENDMGIKYNLSNGGPAPESVTNAIWEISKKLTSYKIIKDFPELDLGTIGKNKKYGPLLVDIIDITKDYVNFLKEIFDFDLIKKFIDNQRSTKNWKLLFDSMNGVTGPYGKAIFVDEFGLPADEVLQNWHPSPDFGGMHPDPNLTYASSLVKRVDREKIEFGAASDGDGDRNMIYGYGPSFVSPGDSVAIIAEYAAEIPYFAKQGIYGLARSFPTSGAIDRVAKAHGLNCYEVPTGWKFFCALFDAKKLSICGEESFGTGSNHVREKDGVWAIMAWLNILAIYNKHHPENEASIKTIQNEFWAKYGRTFFTRYDFEKVETEKANKIVDQLRAYVTKSGVVNSAFPADESLKVTDCGDFSYTDLDGSVSDHQGLYVKLSNGARFVLRLSGTGSSGATIRLYIEKYCDDKSQYQKTAEEYLKPIINSVIKFLNFKQVLGTEEPTVRT

SEQ ID NO: 188 - DNA, 984 bp, Artificial Sequence
  pPGK1 promoter nucleotide sequence
ggaagtaccttcaaagaatggggtcttatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaa

SEQ ID NO: 189 - DNA, 1500 bp, Saccharomyces cerevisiae
atgtccactaagaagcacaccaaaacacattccacttatgcattcgagagcaacacaaacagcgttgctgcctcacaaatgagaaacgccttaaacaagttggcggactctagtaaacttgacgatgctgctcgcgctaagtttgagaacgaactggattcgtttttcacgcttttcaggagatatttggtagagaagtcttctagaaccaccttggaatgggacaagatcaagtctcccaacccggatgaagtggttaagtatgaaattatttctcagcagcccgagaatgtctcaaacctttccaaattggctgttttgaagttgaacggtgggctgggtacctccatgggctgcgttggccctaaatctgttattgaagtgagagagggaaacacctttttggatttgtctgttcgtcaaattgaatacttgaacagacagtacgatagcgacgtgccattgttattgatgaattctttcaacactgacaaggatacggaacacttgattaagaagtattccgctaacagaatcagaatcagatctttcaatcaatccaggttcccaagagtctacaaggattctttattgcctgtccccaccgaatacgattctccactggatgcttggtatccaccaggtcacggtgatttgtttgaatctttacacgtatctggtgaactggatgccttaattgcccaaggaagagaaatattatttgtttctaacggtgacaacttgggtgctaccgtcgacttaaaaattttaaaccacatgatcgagactggtgccgaatatataatggaattgactgataagaccagagccgatgttaaaggtggtactttgatttcttacgatggtcaagtccgtttattggaagtcgcccaagttccaaaagaacacattgacgaattcaaaaatatcagaaagtttaccaacttcaacacgaataacttatggatcaatctgaaagcagtaaagaggttgatcgaatcgagcaatttggagatggaaatcattccaaaccaaaaaactataacaagagacggtcatgaaattaatgtcttacaattagaaaccgcttgtggtgctgctatcaggcattttgatggtgctcacggtgttgtcgttccaagatcaagattcttgcctgtcaagacctgttccgatttgttgctggttaaatcagatctattccgtctggaacacggttctttgaagttagacccatcccgttttggtccaaacccattaatcaagttgggctcgcatttcaaaaaggtttctggttttaacgcaagaatccctcacatcccaaaaatcgtcgagctagatcatttgaccatcactggtaacgtctttttaggtaaagatgtcactttgaggggtactgtcatcatcgtttgctccgacggtcataaaatcgatattccaaacggctccatattggaaaatgttgtcgttactggtaatttgcaaatcttggaacattga

SEQ ID NO: 190 - protein, 499 aa, Saccharomyces cerevisiae
MSTKKHTKTHSTYAFESNTNSVAASQMRNALNKLADSSKLDDAARAKFENELDSFFTLFRRYLVEKSSRTTLEWDKIKSPNPDEVVKYEIISQQPENVSNLSKLAVLKLNGGLGTSMGCVGPKSVIEVREGNTFLDLSVRQIEYLNRQYDSDVPLLLMNSFNTDKDTEHLIKKYSANRIRIRSFNQSRFPRVYKDSLLPVPTEYDSPLDAWYPPGHGDLFESLHVSGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLIESSNLEMEIIPNQKTITRDGHEINVLQLETACGAAIRHFDGAHGVVVPRSRFLPVKTCSDLLLVKSDLFRLEHGSLKLDPSRFGPNPLIKLGSHFKKVSGFNARIPHIPKIVELDHLTITGNVFLGKDVTLRGTVIIVCSDGHKIDIPNGSILENVVVTGNLQILEH

SEQ ID NO: 191 - protein, 4 aa, Artificial Sequence
  linker amino acid sequence
KLVK

SEQ ID NO: 192 - protein, 5 aa, Artificial Sequence
  linker amino acid sequence
GGGGS

SEQ ID NO: 193 - protein, 10 aa, Artificial Sequence
  linker amino acid sequence
GGGGSGGGGS

What is claimed is:

1. An in vitro method for producing one or more steviol glycosides and/or glycosylated steviol precursors, or a composition thereof comprising:
    (a) adding a polypeptide capable of glycosylating steviol or a steviol glycoside at its C-19 carboxyl group having at least 90% sequence identity to the amino acid sequence set forth in SEQ ID NO:4, and further having at least one amino acid substitution at residues 68, 69, 70, 71, 72, 73, 74, 75, 76, 77, 78, 79, 80, 81, 82, 83, 184, 260, 286, or 377 of SEQ ID NO:4;
    and a plant-derived or synthetic steviol glycoside precursor or a plant-derived or synthetic steviol precursor to a reaction mixture; and
    (b) producing the one or more steviol glycosides and/or glycosylated steviol precursors, or the composition thereof, thereby;
    wherein the reaction mixture comprises (i) glucose, fructose, sucrose, xylose, rhamnose, uridine diphosphate (UDP)-glucose, UDP-rhamnose, UDP-xylose, and/or N-acetyl-glucosamine: and (ii) reaction buffer and/or salts: and
    wherein the one or more steviol glycosides and/or glycosylated steviol precursors are, or the composition thereof comprises steviol-13-O-glucoside (13-SMG), steviol-19-O-glucoside (19-SMG), steviol-1,2-bioside, steviol-1,3-bioside, 1,2-stevioside, 1,3-stevioside, rubusoside, Rebaudioside A (RebA), Rebaudioside B (RebB), Rebaudioside C (RebC), Rebaudioside D (RebD), Rebaudioside E (RebE), Rebaudioside F (RebF), Rebaudioside M (RebM), Rebaudioside Q (RebQ), Rebaudioside I (RebI), dulcoside A, a mono-glycosylated ent-kaurenoic acid, a di-glycosylated ent-kaurenoic acid, a tri-glycosylated ent-kaurenoic acid, a mono-glycosylated ent-kaurenols, a di-glycosylated ent-kaurenol, a tri-glycosylated ent-kaurenol, a tri-glycosylated steviol glycoside, a tetra-glycosylated steviol glycoside, a penta-glycosylated steviol glycoside, a hexa-glycosylated steviol glycoside, a hepta-glycosylated steviol glycoside, or an isomer thereof.

2. The method of claim 1, further comprising:
    (c) recovering the one or more steviol glycosides and/or glycosylated steviol precursors, or the composition thereof from the reaction mixture.

3. The method of claim 1, wherein:
    (a) the di-glycosylated ent-kaurenoic acid comprises ent-kaurenoic acid+2Glc (#7);
    (b) the tri-glycosylated ent-kaurenoic acid comprises ent-kaurenoic acid+3Glc (isomer 1) or ent-kaurenoic acid+3Glc (isomer 2);
    (c) the di-glycosylated ent-kaurenol comprises ent-kaurenol+2Glc (#8);
    (d) the tri-glycosylated ent-kaurenol comprises ent-kaurenol+3Glc (isomer 1) or ent-kaurenol+3Glc (#6);
    (e) the steviol glycoside comprises 13-SMG, 19-SMG, steviol-1,2-bioside, steviol-1,3-bioside, rubusoside, RebA, RebE, RebD or RebM;
    (f) the tetra-glycosylated steviol comprises steviol+4Glc (#26) or steviol+4Glc (#33);
    (g) the penta-glycosylated steviol comprises steviol+5Glc (#24) or steviol+5Glc (#25);
    (h) the hexa-glycosylated steviol comprises steviol+6Glc (isomer 1) or steviol+6Glc (#23); and
    (i) the hepta-glycosylated steviol comprises steviol+7Glc (isomer 2) or steviol+7Glc (isomer 5).

4. The method of claim 1, wherein the polypeptide comprises a M79V, M79E, S80C, A81W, E83K, A81W and E83K, H184V, H184T, N260T, K286C, N260T and K286C, K286E, K286N, K286T, and/or S377Q amino acid substitution of SEQ ID NO:4.

5. The method of claim 1, wherein one or more of a polypeptide capable of beta 1,3 glycosylation of the C3' of the 13-O-glucose, 19-O-glucose, or both 13-O-glucose and 19-O-glucose of a steviol glycoside, a polypeptide capable of beta 1,2 glycosylation of the C2' of the 13-O-glucose, 19-O-glucose, or both 13-O-glucose and 19-O-glucose of a steviol glycoside, a polypeptide capable of glycosylating steviol or a steviol glycoside at its C-13 hydroxyl group, or a polypeptide capable of glycosylating steviol or a steviol glycoside at its C-19 carboxyl group are further added to the reaction mixture, wherein:
    (a) the polypeptide capable of glycosylating steviol or the steviol glycoside at its C-13 hydroxyl group thereof comprises a polypeptide having at least 90% sequence identity to the amino acid sequence set forth in SEQ ID NO:7:
    (b) the polypeptide capable of beta 1,3 glycosylation of the C3' of the 13-O-glucose, 19-O-glucose, or both 13-O-glucose and 19-O-glucose of the steviol glycoside comprises a polypeptide having at least 90% sequence identity to the amino acid sequence set forth in SEQ ID NO:9;
    (c) the polypeptide capable of glycosylating steviol or the steviol glycoside at its C-19 carboxyl group thereof comprises a polypeptide having at least 90% sequence identity to the amino acid sequence set forth in SEQ ID NO:4; and
    (d) the polypeptide capable of beta 1,2 glycosylation of the C2' of the 13-O-glucose, 19-O-glucose, or both 13-O-glucose and 19-O-glucose of the steviol glycoside comprises a polypeptide having at least 90% sequence identity to the amino acid sequence set forth in SEQ ID NO:16 or a polypeptide having at least 90% sequence identity to the amino acid sequence set forth in SEQ ID NO: 11 or 13.

6. The method of claim 1, wherein the polypeptide capable of glycosylating steviol or the steviol glycoside at its C-19 carboxyl group further comprises a tag sequence having at least 90% identity to any one of SEQ ID NOs: 152-155.

* * * * *